US009888673B2

(12) United States Patent
Hering et al.

(10) Patent No.: US 9,888,673 B2
(45) Date of Patent: Feb. 13, 2018

(54) GENETICALLY MODIFIED CELLS, TISSUES, AND ORGANS FOR TREATING DISEASE

(71) Applicant: Regents of the University of Minnesota, Minneapolis, MN (US)

(72) Inventors: Bernhard J. Hering, Minnetonka, MN (US); Christopher Burlak, Minnetonka, MN (US)

(73) Assignee: REGENTS OF THE UNIVERSITY OF MINNESOTA, Minneapolis, MN (US)

( * ) Notice: Subject to any disclaimer, the term of this patent is extended or adjusted under 35 U.S.C. 154(b) by 0 days.

(21) Appl. No.: 14/965,451

(22) Filed: Dec. 10, 2015

(65) Prior Publication Data

US 2016/0165861 A1 Jun. 16, 2016

Related U.S. Application Data

(60) Provisional application No. 62/090,037, filed on Dec. 10, 2014, provisional application No. 62/253,493, filed on Nov. 10, 2015.

(51) Int. Cl.
| | |
|---|---|
| *A01K 15/00* | (2006.01) |
| *A01K 67/027* | (2006.01) |
| *C12N 5/071* | (2010.01) |
| *C07K 16/28* | (2006.01) |
| *A61K 39/395* | (2006.01) |
| *A61K 45/06* | (2006.01) |
| *A61K 35/12* | (2015.01) |
| *A61K 35/15* | (2015.01) |
| *A61K 35/26* | (2015.01) |
| *A61K 35/28* | (2015.01) |
| *A61K 35/39* | (2015.01) |
| *C12N 15/113* | (2010.01) |

(52) U.S. Cl.
CPC .......... *A01K 67/0275* (2013.01); *A61K 35/12* (2013.01); *A61K 35/15* (2013.01); *A61K 35/26* (2013.01); *A61K 35/28* (2013.01); *A61K 35/39* (2013.01); *A61K 39/395* (2013.01); *A61K 45/06* (2013.01); *C07K 16/2833* (2013.01); *C07K 16/2866* (2013.01); *C07K 16/2878* (2013.01); *C07K 16/2887* (2013.01); *C12N 5/0676* (2013.01); *C12N 5/0677* (2013.01); *A01K 2217/15* (2013.01); *A01K 2227/108* (2013.01); *A01K 2267/025* (2013.01); *C07K 2317/76* (2013.01); *C07K 2319/30* (2013.01); *C12N 15/113* (2013.01); *C12N 2310/10* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 4,702,907 A | 10/1987 | Becker et al. | |
| 6,051,228 A | 4/2000 | Aruffo et al. | |
| 6,056,959 A | 5/2000 | De et al. | |
| 6,280,957 B1 | 8/2001 | Sayegh et al. | |
| 6,296,846 B1 | 10/2001 | Sachs et al. | |
| 6,312,693 B1 | 11/2001 | Aruffo et al. | |
| 6,403,091 B1 | 6/2002 | Lederman et al. | |
| 6,413,514 B1 | 7/2002 | Aruffo et al. | |
| 6,514,513 B1 | 2/2003 | Sykes | |
| 6,849,448 B1 | 2/2005 | D'Apice et al. | |
| 6,866,843 B2 | 3/2005 | Habener et al. | |
| 6,923,959 B2 | 8/2005 | Habener et al. | |
| 7,115,796 B2 | 10/2006 | Tzang et al. | |
| 7,166,278 B2 | 1/2007 | Zhu | |
| 7,193,064 B2 | 3/2007 | Mikayama et al. | |
| 7,445,780 B2 | 11/2008 | Chu et al. | |
| 7,452,981 B2 | 11/2008 | Wijdenes et al. | |
| 7,537,756 B2 | 5/2009 | Habener et al. | |
| 7,547,438 B2 | 6/2009 | Thomas et al. | |
| 7,780,993 B2 | 8/2010 | Reisner et al. | |
| 7,919,673 B2 | 4/2011 | Wolf et al. | |
| 7,989,675 B2 | 8/2011 | Welsh et al. | |
| 8,034,330 B2 | 10/2011 | Zhu | |
| 8,173,861 B2 | 5/2012 | Madsen et al. | |
| 8,277,810 B2 | 10/2012 | Long et al. | |
| 8,309,791 B2 | 11/2012 | Fahrenkrug et al. | |
| 8,389,794 B2 | 3/2013 | Jorgensen et al. | |
| 8,546,553 B2 | 10/2013 | Terns et al. | |
| 8,551,485 B2 | 10/2013 | Bernett et al. | |
| 8,568,725 B2 | 10/2013 | Takahashi et al. | |
| 8,637,032 B2 | 1/2014 | Long et al. | |
| 8,669,352 B2 | 3/2014 | Den et al. | |
| 8,697,359 B1 | 4/2014 | Zhang | |

(Continued)

FOREIGN PATENT DOCUMENTS

| | | |
|---|---|---|
| AU | 735592 B2 | 7/2001 |
| CA | 2551008 A1 | 7/2005 |

(Continued)

OTHER PUBLICATIONS

Secher et al. Theriogenol 2016;85:162-71.*
Yum et al. J Vet Sci 2016;17:261-8.*
West et al. J Equine Vet Sci 2016;41:1-6.*
Bailey, et al. Baboon-to-human cardiac xenotransplantation in a neonate. JAMA. Dec. 20, 1985;254(23):3321-9.
Basler, et al. Inhibition of the immunoproteasome ameliorates experimental autoimmune encephalomyelitis. EMBO Mol Med. Feb. 2014;6(2):226-38. doi: 10.1002/emmm.201303543. Epub Jan. 16, 2014.
Beaton, et al. Recombinase-mediated gene stacking in swine. In Transgenic Research. Feb. 2014, vol. 23, No. 1, pp. 202-202. Van Godewijckstraat 30, 3311 GZ Dordrecht, Netherlands: Springer.
Benko, et al. NLRC5 limits the activation of inflammatory pathways. J Immunol. Aug. 1, 2010;185(3):1681-91. doi: 10.4049/jimmunol.0903900. Epub Jul. 7, 2010.

(Continued)

*Primary Examiner* — Janice Li
(74) *Attorney, Agent, or Firm* — Wilson Sonsini Goodrich & Rosati

(57) ABSTRACT

Genetically modified cells, tissues, and organs for treating or preventing diseases are disclosed. Also disclosed are methods of making the genetically modified cells and non-human animals.

13 Claims, 69 Drawing Sheets

(56) References Cited

U.S. PATENT DOCUMENTS

| | | |
|---|---|---|
| 8,709,400 B2 | 4/2014 | Hammerman |
| 8,734,786 B2 | 5/2014 | Miller et al. |
| 8,771,945 B1 | 7/2014 | Zhang |
| 8,795,965 B2 | 8/2014 | Zhang |
| 8,828,396 B2 | 9/2014 | Heusser et al. |
| 8,865,406 B2 | 10/2014 | Zhang et al. |
| 8,871,445 B2 | 10/2014 | Zhang et al. |
| 8,889,356 B2 | 11/2014 | Zhang |
| 8,889,365 B2 | 11/2014 | Madura et al. |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,911,726 B2 | 12/2014 | Takahashi et al. |
| 8,921,332 B2 | 12/2014 | Choulika et al. |
| 8,932,814 B2 | 1/2015 | Zhang et al. |
| 8,945,839 B2 | 2/2015 | Zhang |
| 8,974,779 B2 | 3/2015 | Reisner et al. |
| 8,993,233 B2 | 3/2015 | Zhang et al. |
| 8,999,641 B2 | 4/2015 | Zhang et al. |
| 9,023,649 B2 | 5/2015 | Mali et al. |
| 9,125,893 B2 | 9/2015 | Endo et al. |
| 9,131,589 B2 | 9/2015 | Hayashi et al. |
| 9,234,213 B2 | 1/2016 | Wu |
| 9,260,723 B2 | 2/2016 | Mali et al. |
| 9,260,752 B1 | 2/2016 | May et al. |
| 9,339,519 B2 | 5/2016 | Ayares |
| 9,362,208 B2 | 6/2016 | Schwab et al. |
| 9,404,098 B2 | 8/2016 | Terns et al. |
| 9,410,198 B2 | 8/2016 | May et al. |
| 9,422,553 B2 | 8/2016 | Terns et al. |
| 9,458,439 B2 | 10/2016 | Choulika et al. |
| 9,475,879 B2 | 10/2016 | Suri et al. |
| 2001/0051156 A1 | 12/2001 | Zeng et al. |
| 2002/0006403 A1 | 1/2002 | Yu et al. |
| 2003/0024002 A1 | 1/2003 | Colman et al. |
| 2003/0118568 A1 | 6/2003 | Crew |
| 2003/0153518 A1 | 8/2003 | Foxwell et al. |
| 2004/0028243 A1 | 2/2004 | Seo et al. |
| 2005/0260176 A1 | 11/2005 | Ayares et al. |
| 2007/0178068 A1 | 8/2007 | Reich et al. |
| 2009/0202531 A1 | 8/2009 | Aukerman et al. |
| 2009/0304706 A1 | 12/2009 | Lu et al. |
| 2010/0021433 A1 | 1/2010 | Reisner et al. |
| 2010/0076057 A1 | 3/2010 | Sontheimer et al. |
| 2010/0093617 A1 | 4/2010 | Barrangou et al. |
| 2010/0221270 A1 | 9/2010 | Reisner et al. |
| 2011/0002934 A1 | 1/2011 | Luqman et al. |
| 2011/0038841 A1 | 2/2011 | Ayares |
| 2011/0217739 A1 | 9/2011 | Terns et al. |
| 2012/0112586 A1 | 5/2012 | Hsiao |
| 2012/0121585 A1 | 5/2012 | Heusser et al. |
| 2013/0011828 A1 | 1/2013 | Barrangou et al. |
| 2013/0111614 A1 | 5/2013 | McGregor et al. |
| 2013/0177577 A1 | 7/2013 | Kobayashi et al. |
| 2014/0004131 A1 | 1/2014 | Mueller et al. |
| 2014/0017215 A1 | 1/2014 | Ayares |
| 2014/0066505 A1 | 3/2014 | Joshi et al. |
| 2014/0068797 A1 | 3/2014 | Doudna et al. |
| 2014/0093497 A1 | 4/2014 | Reimann et al. |
| 2014/0099317 A1 | 4/2014 | Suri et al. |
| 2014/0105907 A1 | 4/2014 | Takahashi et al. |
| 2014/0112958 A1 | 4/2014 | Wolf et al. |
| 2014/0113376 A1 | 4/2014 | Sorek et al. |
| 2014/0115728 A1 | 4/2014 | Tector |
| 2014/0120152 A1 | 5/2014 | Luo et al. |
| 2014/0199767 A1 | 7/2014 | Barrangou et al. |
| 2014/0205602 A1 | 7/2014 | Long et al. |
| 2014/0242702 A1 | 8/2014 | Chen et al. |
| 2014/0248266 A1 | 9/2014 | Takahashi et al. |
| 2014/0273223 A1 | 9/2014 | Cho et al. |
| 2014/0273226 A1 | 9/2014 | Wu |
| 2014/0273230 A1 | 9/2014 | Chen et al. |
| 2014/0294773 A1 | 10/2014 | Brouns et al. |
| 2014/0295556 A1 | 10/2014 | Joung et al. |
| 2014/0295557 A1 | 10/2014 | Joung et al. |
| 2014/0315985 A1 | 10/2014 | May et al. |
| 2014/0341898 A1 | 11/2014 | Heusser et al. |
| 2014/0342457 A1 | 11/2014 | Mali et al. |
| 2014/0348832 A1 | 11/2014 | Zhu et al. |
| 2015/0020233 A1 | 1/2015 | Harriman et al. |
| 2015/0024499 A1 | 1/2015 | Brouns et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0059010 A1 | 2/2015 | Cigan et al. |
| 2015/0079681 A1 | 3/2015 | Zhang |
| 2015/0082478 A1 | 3/2015 | Cigan et al. |
| 2015/0086559 A1 | 3/2015 | Mueller et al. |
| 2015/0098954 A1 | 4/2015 | Hyde et al. |
| 2015/0140664 A1 | 5/2015 | Byrne et al. |
| 2015/0152436 A1 | 6/2015 | Musunuru et al. |
| 2015/0166980 A1 | 6/2015 | Liu et al. |
| 2015/0174294 A1 | 6/2015 | Reisner et al. |
| 2015/0176013 A1 | 6/2015 | Musunuru et al. |
| 2015/0184139 A1 | 7/2015 | Zhang et al. |
| 2015/0203872 A1 | 7/2015 | Zhang |
| 2015/0211023 A1 | 7/2015 | Shiboleth et al. |
| 2015/0232881 A1 | 8/2015 | Glucksmann et al. |
| 2015/0232883 A1 | 8/2015 | Dahlman et al. |
| 2015/0240261 A1 | 8/2015 | Siksnys et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0264900 A1 | 9/2015 | Tector |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0322457 A1 | 11/2015 | Kim et al. |
| 2015/0344912 A1 | 12/2015 | Kim et al. |
| 2015/0356239 A1 | 12/2015 | Zhang et al. |
| 2016/0002670 A1 | 1/2016 | Church et al. |
| 2016/0007929 A1 | 1/2016 | Chuang et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0032274 A1 | 2/2016 | Church et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0060653 A1 | 3/2016 | Doudna et al. |
| 2016/0060654 A1 | 3/2016 | Doudna et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0130609 A1 | 5/2016 | Doudna et al. |
| 2016/0138027 A1 | 5/2016 | Gan et al. |
| 2016/0138046 A1 | 5/2016 | Wu |
| 2016/0153004 A1 | 6/2016 | Zhang et al. |
| 2016/0153005 A1 | 6/2016 | Zhang et al. |
| 2016/0153006 A1 | 6/2016 | Zhang et al. |
| 2016/0160210 A1 | 6/2016 | Mali et al. |
| 2016/0168594 A1 | 6/2016 | Zhang et al. |
| 2016/0175462 A1 | 6/2016 | Zhang et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0208243 A1 | 7/2016 | Zhang et al. |
| 2016/0237455 A1 | 8/2016 | Glucksmann et al. |
| 2016/0251640 A1 | 9/2016 | May et al. |
| 2016/0272965 A1 | 9/2016 | Zhang et al. |

(56) References Cited

U.S. PATENT DOCUMENTS

| | | |
|---|---|---|
| 2016/0281072 A1 | 9/2016 | Zhang |
| 2016/0298096 A1 | 10/2016 | Charpentier et al. |
| 2016/0304907 A1 | 10/2016 | Mali et al. |
| 2016/0319349 A1 | 11/2016 | May et al. |

FOREIGN PATENT DOCUMENTS

| | | |
|---|---|---|
| CN | 102851279 A | 1/2013 |
| EP | 0757557 A1 | 2/1997 |
| EP | 1004238 A1 | 5/2000 |
| EP | 1707627 A1 | 7/2005 |
| EP | 2453008 A2 | 5/2012 |
| EP | 2683406 A2 | 1/2014 |
| EP | 1383889 B1 | 11/2014 |
| JP | 4242388 B2 | 3/2009 |
| WO | WO-9747321 A1 | 12/1997 |
| WO | WO-9909167 A1 | 2/1999 |
| WO | WO-0037102 A2 | 6/2000 |
| WO | WO-0115521 A1 | 3/2001 |
| WO | WO-0119181 A1 | 3/2001 |
| WO | WO-0228481 A2 | 4/2002 |
| WO | WO-02079477 A2 | 10/2002 |
| WO | WO-02088351 A1 | 11/2002 |
| WO | WO-03038049 A2 | 5/2003 |
| WO | WO-2004028243 A2 | 4/2004 |
| WO | WO-2005044294 A2 | 5/2005 |
| WO | WO-2006030220 A1 | 3/2006 |
| WO | WO-2007025097 A2 | 3/2007 |
| WO | WO-2007136815 A2 | 11/2007 |
| WO | WO-2008002767 A1 | 1/2008 |
| WO | WO-2010011961 A2 | 1/2010 |
| WO | WO-2010054108 A2 | 5/2010 |
| WO | WO-2011020120 A2 | 2/2011 |
| WO | WO-2011139488 A2 | 11/2011 |
| WO | WO-2012009337 A2 | 1/2012 |
| WO | WO-2012112586 A1 | 8/2012 |
| WO | WO-2012125569 A1 | 9/2012 |
| WO | WO-2012145673 A1 | 10/2012 |
| WO | WO-2012164565 A1 | 12/2012 |
| WO | WO-2013063076 A1 | 5/2013 |
| WO | WO-2013088446 A1 | 6/2013 |
| WO | WO-2013098244 A1 | 7/2013 |
| WO | WO-2013141680 A1 | 9/2013 |
| WO | WO-2013169929 A1 | 11/2013 |
| WO | WO-2013176772 A1 | 11/2013 |
| WO | WO-2014039782 A2 | 3/2014 |
| WO | WO-2014065596 A1 | 5/2014 |
| WO | WO-2014066505 A1 | 5/2014 |
| WO | WO-2014089290 A1 | 6/2014 |
| WO | WO-2014093595 A1 | 6/2014 |
| WO | WO-2014093622 A2 | 6/2014 |
| WO | WO-2014093655 A2 | 6/2014 |
| WO | WO-2014093661 A2 | 6/2014 |
| WO | WO-2014093709 A1 | 6/2014 |
| WO | WO-2014093712 A1 | 6/2014 |
| WO | WO-2014099744 A1 | 6/2014 |
| WO | WO-2014099750 A2 | 6/2014 |
| WO | WO-2014130955 A1 | 8/2014 |
| WO | WO-2014150624 A1 | 9/2014 |
| WO | WO-2014165825 A2 | 10/2014 |
| WO | WO-2014186585 A2 | 11/2014 |
| WO | WO-2014191518 A1 | 12/2014 |
| WO | WO-2014204723 A1 | 12/2014 |
| WO | WO-2014204725 A1 | 12/2014 |
| WO | WO-2014204726 A1 | 12/2014 |
| WO | WO-2014204727 A1 | 12/2014 |
| WO | WO-2014204728 A1 | 12/2014 |
| WO | WO-2014204729 A1 | 12/2014 |
| WO | WO-2015006294 A2 | 1/2015 |
| WO | WO-2015026887 A2 | 2/2015 |
| WO | WO-2015048577 A2 | 4/2015 |
| WO | WO-2015052133 A1 | 4/2015 |
| WO | WO-2015053995 A1 | 4/2015 |
| WO | WO-2015054253 A1 | 4/2015 |
| WO | WO-2015070083 A1 | 5/2015 |
| WO | WO-2015071474 A2 | 5/2015 |
| WO | WO-2015079056 A1 | 6/2015 |
| WO | WO-2015089419 A2 | 6/2015 |
| WO | WO-2015155686 A2 | 10/2015 |
| WO | WO-2016057821 A2 | 4/2016 |
| WO | WO-2016057835 A2 | 4/2016 |
| WO | WO-2016057961 A1 | 4/2016 |
| WO | WO-2017040932 A1 | 3/2017 |

OTHER PUBLICATIONS

Biswas, et al. Cutting edge: impaired MHC class I expression in mice deficient for Nlrc5/class I transactivator. J Immunol. Jul. 15, 2012;189(2):516-20. doi: 10.4049/jimmunol.1200064. Epub Jun. 18, 2012.

Brandhorst, et al. Significant progress in porcine islet mass isolation utilizing liberase HI for enzymatic low-temperature pancreas digestion. Transplantation. Aug. 15, 1999;68(3):355-61.

Bryant, et al. Nanoparticle delivery of donor antigens for transplant tolerance in allogeneic islet transplantation. Biomaterials. Oct. 2014;35(31):8887-94. doi: 10.1016/j.biomaterials.2014.06.044. Epub Jul. 25, 2014.

Bryant, et al. Preemptive donor apoptotic cell infusions induce IFN-γ-producing myeloid-derived suppressor cells for cardiac allograft protection. J Immunol. Jun. 15, 2014;192(12):6092-101. doi: 10.4049/jimmunol.1302771. Epub May 7, 2014.

Burlak, et al. Reduced binding of human antibodies to cells from GGTA1/CMAH KO pigs. Am J Transplant. Aug. 2014;14(8):1895-900. doi: 10.1111/ajt.12744. Epub Jun. 6, 2014.

Burns, et al. Alloantibodies prevent the induction of transplantation tolerance by enhancing alloreactive T cell priming. J Immunol. Jan. 1, 2011;186(1):214-21. doi: 10.4049/jimmunol.1001172. Epub Dec. 6, 2010.

Chatterjee. A controlled comparative study of the use of porcine xenograft in the treatment of partial thickness skin loss in an occupational health centre. Curr Med Res Opin. 1978;5(9):726-33.

Chen, et al. Intragraft CD11b(+) Ido(+) cells mediate cardiac allograft tolerance by ECDI-fixed donor splenocyte infusions. Am J Transplant. Nov. 2012;12(11):2920-9. doi: 10.1111/j.1600-6143. 2012.04203.x. Epub Aug. 6, 2012.

Cho, et al. Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Choudhary, et al. Evidence-informed clinical practice recommendations for treatment of type 1 diabetes complicated by problematic hypoglycemia. Diabetes Care. Jun. 2015;38(6):1016-29. doi: 10.2337/dc15-0090.

Cordoba, et al. A novel, blocking, Fc-silent anti-CD40 monoclonal antibody prolongs nonhuman primate renal allograft survival in the absence of B cell depletion. Am J Transplant. Nov. 2015;15(11):2825-36. doi: 10.1111/ajt.13377. Epub Jul. 2, 2015.

Crew, et al. Exploiting virus stealth technology for xenotransplantation: reduced human T cell responses to porcine cells expressing herpes simplex virus ICP47. Xenotransplantation. Jan. 2003;10(1):50-9.

Cui, et al. NLRC5 negatively regulates the NF-kappaB and type I interferon signaling pathways. Cell. Apr. 30, 2010;141(3):483-96. doi: 10.1016/j.cell.2010.03.040.

Dai, et al. Targeted disruption of the alpha1,3-galactosyltransferase gene in cloned pigs. Nat Biotechnol. Mar. 2002;20(3):251-5.

Davis, et al. Cutting edge: NLRC5-dependent activation of the inflammasome. J Immunol. Feb. 1, 2011;186(3):1333-7. doi: 10.4049/jimmunol.1003111. Epub Dec. 29, 2010.

Dersimonian, et al. Human anti-porcine T cell response: blocking with anti-class I antibody leads to hyporesponsiveness and a switch in cytokine production. J Immunol. Jun. 15, 1999;162(12):6993-7001.

Fink, et al. Porcine xenografts in Parkinson's disease and Huntington's disease patients: preliminary results. Cell Transplant. Mar.-Apr. 2000;9(2):273-8.

(56) References Cited

OTHER PUBLICATIONS

Flori, et al. Transcriptomic analysis of the dialogue between Pseudorabies virus and porcine epithelial cells during infection. BMC Genomics. Mar. 10, 2008;9:123. doi: 10.1186/1471-2164-9-123.

Fu, et al. High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.

Galili, et al. Evolutionary relationship between the natural anti-Gal antibody and the Gal alpha 1-3Gal epitope in primates. Proc Natl Acad Sci U S A. Mar. 1987;84(5):1369-73.

Galili, et al. Interaction between human natural anti-alpha-galactosyl immunoglobulin G and bacteria of the human flora. Infect Immun. Jul. 1988;56(7):1730-7.

Gobin, et al. The MHC-specific enhanceosome and its role in MHC class I and beta(2)-microglobulin gene transactivation. J Immunol. Nov. 1, 2001;167(9):5175-84.

Gomes, et al. Non-classical major histocompatibility complex proteins as determinants of tumour immunosurveillance. EMBO Rep. Nov. 2007;8(11):1024-30.

Goncalves, et al. Stem cells and regenerative medicine in domestic and companion animals: a multispecies perspective. Reprod Domest Anim. Oct. 2014;49 Suppl 4:2-10. doi: 10.1111/rda.12392.

Gould, et al. Direct and indirect recognition: the role of MHC antigens in graft rejection. Immunol Today. Feb. 1999;20(2):77-82.

Griesemer, et al. Xenotransplantation: immunological hurdles and progress toward tolerance. Immunol Rev. Mar. 2014;258(1):241-58. doi: 10.1111/imr.12152.

Gun, et al. Current progress of genetically engineered pig models for biomedical research. Biores Open Access. Dec. 1, 2014;3(6):255-64. doi: 10.1089/biores.2014.0039.

Hai, et al. One-step generation of knockout pigs by zygote injection of CRISPR/Cas system. Cell Res. Mar. 2014;24(3):372-5. doi: 10.1038/cr.2014.11. Epub Jan. 31, 2014.

Hall. Porcine embryonic stem cells: a possible source for cell replacement therapy. Stem Cell Rev. Dec. 2008;4(4):275-82. doi: 10.1007/s12015-008-9040-2.

Hsu, et al. DNA targeting specificity of RNA-guided Cas9 nucleases. Nat Biotechnol. Sep. 2013;31(9):827-32. doi: 10.1038/nbt.2647. Epub Jul. 21, 2013.

International search report and written opinion dated Apr. 22, 2016 for PCT/US2015/065029.

Irion, et al. Identification and targeting of the ROSA26 locus in human embryonic stem cells. Nat Biotechnol. Dec. 2007;25(12):1477-82. Epub Nov. 25, 2007.

Katopodis, et al. Removal of anti-Galalpha1,3Gal xenoantibodies with an injectable polymer. J Clin Invest. Dec. 2002;110(12):1869-77.

Kheradmand, et al. Permanent protection of PLG scaffold transplanted allogeneic islet grafts in diabetic mice treated with ECDI-fixed donor splenocyte infusions. Biomaterials. Jul. 2011;32(20):4517-24. doi: 10.1016/j.biomaterials.2011.03.009. Epub Apr. 1, 2011.

Kong, et al. Rosa26 locus supports tissue-specific promoter driving transgene expression specifically in pig. PLoS One. Sep. 18, 2014;9(9):e107945. doi: 10.1371/journal.pone.0107945. eCollection 2014.

Korbutt, GS. The International Xenotransplantation Association consensus statement on conditions for undertaking clinical trials of porcine islet products in type 1 diabetes—chapter 3: Pig islet product manufacturing and release testing. Xenotransplantation. Jul.-Aug. 2009;16(4):223-8. doi: 10.1111/j.1399-3089.2009.00542.x.

Krawczyk, et al. Long distance control of MHC class Ii expression by multiple distal enhancers regulated by regulatory factor X complex and CIITA. J Immunol. Nov. 15, 2004;173(10):6200-10.

Kulick, et al. Transgenic swine lungs expressing human CD59 are protected from injury in a pig-to-human model of xenotransplantation. J Thorac Cardiovasc Surg. Apr. 2000;119(4 Pt 1):690-9.

Kumar, et al. NLRC5 deficiency does not influence cytokine induction by virus and bacteria infections. J Immunol. Jan. 15, 2011;186(2):994-1000. doi: 10.4049/jimmunol.1002094. Epub Dec. 8, 2010.

Lai, et al. Production of alpha-1,3-galactosyltransferase knockout pigs by nuclear transfer cloning. Science. Feb. 8, 2002;295(5557):1089-92. Epub Jan. 3, 2002.

Larkin, et al. Genetic Deficiency of Complement Component 3 Does Not Alter Disease Progression in a Mouse Model of Huntington's Disease. J Huntingtons Dis. 2012;1(1):107-18. doi: 10.3233/JHD-2012-120021.

Li, et al. Efficient generation of genetically distinct pigs in a single pregnancy using multiplexed single-guide RNA and carbohydrate selection. Xenotransplantation. Jan.-Feb. 2015;22(1):20-31. doi: 10.1111/xen.12131. Epub Sep. 2, 2014.

Li, et al. Identification and cloning of the porcine ROSA26 promoter and its role in transgenesis. Transplantation Technology, 2014; 2(1), 1.

Li, et al. Rosa26-targeted swine models for stable gene overexpression and Cre-mediated lineage tracing. Cell Res. Apr. 2014;24(4):501-4. doi: 10.1038/cr.2014.15. Epub Feb. 7, 2014.

Lilienfeld, et al. Transgenic expression of HLA-E single chain trimer protects porcine endothelial cells against human natural killer cellmediated cytotoxicity. Xenotransplantation. Mar. 2007;14(2):126-34.

Luo, et al. ECDI-fixed allogeneic splenocytes induce donor-specific tolerance for long-term survival of islet transplants via two distinct mechanisms. Proc Natl Acad Sci U S A. Sep. 23, 2008;105(38):14527-32. doi: 10.1073/pnas.0805204105. Epub Sep. 16, 2008.

Mair, et al. The porcine innate immune system: an update. Dev Comp Immunol. Aug. 2014;45(2):321-43. doi: 10.1016/j.dci.2014.03.022. Epub Apr. 4, 2014.

Matsumoto, et al. Clinical porcine islet xenotransplantation under comprehensive regulation. Transplant Proc. Jul.-Aug. 2014;46(6):1992-5. doi: 10.1016/j.transproceed.2014.06.008.

Matsunami, et al. Modulation of the leader peptide sequence of the HLA-E gene up-regulates its expression and down-regulates natural killer cell-mediated swine endothelial cell lysis. Transplantation. May 27, 2002;73(10):1582-9.

Matsunami, et al. The possible use of HLA-G1 and G3 in the inhibition of NK cell-mediated swine endothelial cell lysis. Clin Exp Immunol. Oct. 2001;126(1):165-72.

Meissner, et al. NLR family member NLRC5 is a transcriptional regulator of MHC class I genes. Proc Natl Acad Sci USA. Aug. 3, 2010;107(31):13794-9. doi: 10.1073/pnas.1008684107. Epub Jul. 16, 2010.

Meissner, et al. NLRC5: a newly discovered MHC class I transactivator (CITA). Microbes Infect. Jun. 2012;14(6):477-84. doi: 10.1016/j.micinf.2011.12.007. Epub Dec. 22, 2011.

Meyer, et al. Gene targeting by homologous recombination in mouse zygotes mediated by zinc-finger nucleases. Proc Natl Acad Sci U S A. Aug. 24, 2010;107(34):15022-6. doi: 10.1073/pnas.1009424107. Epub Aug. 4, 2010.

Miller, et al. Antigen-specific tolerance strategies for the prevention and treatment of autoimmune disease. Nat Rev Immunol. Sep. 2007;7(9):665-77. Epub Aug. 10, 2007.

Murray, et al. Porcine aortic endothelial cells activate human T cells: direct presentation of MHC antigens and costimulation by ligands for human CD2 and CD28. Immunity. Apr. 1994;1(1):57-63.

Naji, et al. Binding of HLA-G to ITIM-bearing Ig-like transcript 2 receptor suppresses B cell responses. J Immunol. Feb. 15, 2014;192(4):1536-46. doi: 10.4049/jimmunol.1300438. Epub Jan. 22, 2014.

Neerincx, et al. A role for the human nucleotide-binding domain, leucine-rich repeat-containing family member NLRC5 in antiviral responses. J Biol Chem. Aug. 20, 2010;285(34):26223-32. doi: 10.1074/jbc.M110.109736. Epub Jun. 10, 2010.

Neerincx, et al. NLRC5 controls basal MHC class I gene expression in an MHC enhanceosome-dependent manner. J Immunol. May 15, 2012;188(10):4940-50. doi: 10.4049/jimmunol.1103136. Epub Apr. 6, 2012.

(56) References Cited

OTHER PUBLICATIONS

Ohlen, et al. Prevention of allogeneic bone marrow graft rejection by H-2 transgene in donor mice. Science. Nov. 3, 1989246(4930):666-8.
OriGene. CRISPR Manual. http://www.origene.com/CRISPR-CAS9/. Accessed on Sep. 15, 2014. 40 pages.
Pacasova, et al. Cell-surface expression and alloantigenic function of a human nonclassical class I molecule (HLA-E) in transgenic mice. J Immunol. May 1, 1999;162(9):5190-6.
Pagliuca, et al. Generation of functional human pancreatic β cells in vitro. Cell. Oct. 9, 2014;159(2):428-39. doi: 10.1016/j.cell.2014.09.040.
Phelps, et al. Production and characterization of transgenic pigs expressing porcine CTLA4-Ig. Xenotransplantation. Nov.-Dec. 2009;16(6):477-85. doi: 10.1111/j.1399-3089.2009.00533.x.
Phelps, et al. Production of alpha 1,3-galactosyltransferase-deficient pigs. Science. Jan. 17, 2003;299(5605):411-4. Epub Dec. 19, 2002.
Phelps, et al. Production of transgenic pigs with down-regulation of SLA Class II on a GTKO/CD46 genetic background. Lecture presented by David Ayares on Nov. 11, 2013.
Raghavan, et al. MHC class I assembly: out and about. Trends Immunol. Sep. 2008;29(9):436-43. doi: 10.1016/j.it.2008.06.004.
Ran, et al. Genome engineering using the CRISPR-Cas9 system. Nat Protoc. Nov. 2013;8(11):2281-308. doi: 10.1038/nprot.2013.143. Epub Oct. 24, 2013.
Reardon. New Life for Pig Organs. Gene-editing technologies have breathed life into the languishing field of xenotransplantation. Nature. Nov. 12, 2015;527(7577):152-4. doi: 10.1038/527152a.
Rebmann, et al. HLA-G as a tolerogenic molecule in transplantation and pregnancy. J Immunol Res. 2014;2014:297073. doi: 10.1155/2014/297073. Epub Jul. 21, 2014.
Reyes, et al. Creating class I MHC-null pigs using guide RNA and the Cas9 endonuclease. J Immunol. Dec. 1, 2014;193(11):5751-7. doi: 10.4049/jimmunol.1402059. Epub Oct. 22, 2014.
Rivereau, et al. In vitro xenorecognition of adult pig pancreatic islet cells by splenocytes from nonobese diabetic or non-diabetes-prone mice. Transplantation. Sep. 15, 1998;66(5):633-8.
Rood, et al. Islet xenotransplantation: are we really ready for clinical trials? Am J Transplant. Jun. 2006;6(6):1269-74.
Rotem-Yehudar, et al. Downregulation of peptide transporter genes in cell lines transformed with the highly oncogenic adenovirus 12. J Exp Med. Aug. 1, 1994;180(2):477-88.
Rouas-Freiss, et al. The alpha1 domain of HLA-G1 and HLA-G2 inhibits cytotoxicity induced by natural killer cells: is HLA-G the public ligand for natural killer cell inhibitory receptors? Proc Natl Acad Sci U S A. May 13, 1997;94(10):5249-54.
Sachs, et al. Achieving tolerance in pig-to-primate xenotransplantation: reality or fantasy. Transpl Immunol. Jun. 2009;21(2):101-5. doi: 10.1016/j.trim.2008.11.005. Epub Dec. 6, 2008.
Sasaki, et al. HLA-E and HLA-G expression on porcine endothelial cells inhibit xenoreactive human Nk cells through CD94/NKG2-dependent and -independent pathways. J Immunol. Dec. 1, 1999;163(11):6301-5.
Sasaki, et al. HLA-G expression protects porcine endothelial cells against natural killer cell mediated xenogeneic cytotoxicity. Transplantation. Jan. 15, 1999;67(1):31-7.
Staehli, et al. NLRC5 deficiency selectively impairs MHC class I-dependent lymphocyte killing by cytotoxic T cells. J Immunol. Apr. 15, 2012;188(8):3820-8. doi: 10.4049/jimmunol.1102671. Epub Mar. 12, 2012.
Tector, et al. One-Step Elimination of Pig Classical Class I MHC Genes. In Transplantation. 2014, vol. 98, pp. 30-30, Abstract #1425.
Tong, et al. Enhanced TLR-induced NF-κB signaling and type I interferon responses in NLRC5 deficient mice. Cell Res. May 2011;22(5):822-35. doi: 10.1038/cr.2012.53. Epub Apr. 3, 2012.
Van Kaer, et al. TAP1 mutant mice are deficient in antigen presentation, surface class I molecules, and CD4-8+ T cells. Cell. Dec. 24, 1992;71(7):1205-14.
Waddell, et al. Towards resolving the interordinal relationships of placental mammals. Syst Biol. Mar. 1999;48(1):1-5.

Wang, et al. ECDI-Fixed Donor SPs Infusion Based Combination Treatment for Induction of Tolerance in Porcine to Mouse Islet Xenotransplantion. In Transplantation. 2014, vol. 98, pp. 30-30, Abstract #1423.
Wang, et al. Preemptive Tolerogenic Delivery of Donor Antigens for Permanent Allogeneic Islet Graft Protection. Cell Transplant. 2015;24(6):1155-65. doi: 10.3727/096368914X681027. Epub Apr. 22, 2014.
Wang, et al. Transient B-cell depletion combined with apoptotic donor splenocytes induces xeno-specific T- and B-cell tolerance to islet xenografts. Diabetes. Sep. 2013;62(9):3143-50. doi: 10.2337/db12-1678. Epub Jul. 12, 2013.
Watanabe, et al. ASKP1240, a fully human anti-CD40 monoclonal antibody, prolongs pancreatic islet allograft survival in nonhuman primates. Am J Transplant. Aug. 2013;13(8):1976-88. doi: 10.1111/ajt.12330. Epub Jul. 10, 2013.
Weiss, et al. HLA-E/human beta2-microglobulin transgenic pigs: protection against xenogeneic human anti-pig natural killer cell cytotoxicity. Transplantation. Jan. 15, 2009;87(1):35-43. doi: 10.1097/TP.0b013e318191c784.
Whitworth, et al. Use of the CRISPR/Cas9 system to produce genetically engineered pigs from in vitro-derived oocytes and embryos. Biol Reprod. Sep. 2014;91(3):78, 1-13. doi: 10.1095/biolreprod.114.121723. Epub Aug. 6, 2014.
Whyte, et al. Genetic modifications of pigs for medicine and agriculture. Mol Reprod Dev. Oct.-Nov. 2011;78(10-11):879-91. doi: 10.1002/mrd.21333. Epub Jun. 10, 2011.
Xia, et al. Acylation-stimulating protein (ASP)/complement C3adesArg deficiency results in increased energy expenditure in mice. J Biol Chem. Feb. 6, 2004;279(6):4051-7. Epub Nov. 13, 2003.
Zhao, et al. Genetic variations of TAP1 gene exon 3 affects gene expression and *Escherichia coli* F18 resistance in piglets. Int J Mol Sci. Jun. 20, 2014;15(6):11161-71. doi: 10.3390/ijms150611161.
Abdelli S, Abderrahmani A, Hering BJ, Beckmann JS, Bonny C. The c-Jun N-terminal kinase JNK participates in cytokine- and isolation stress-induced rat pancreatic islet apoptosis. Diabetologia. Aug. 2007;50(8):1660-9. PubMed PMID: 17558486.
Abdelli S, Ansite J, Roduit R, Borsello T, Matsumoto I, Sawada T, Allaman-Pillet N, Henry H, Beckmann JS, Hering BJ, Bonny C. Intracellular stress signaling pathways activated during human islet preparation and following acute cytokine exposure. Diabetes. Nov. 2004;53(11):2815-23. PubMed PMID: 15504961.
Abdelli S, Papas KK, Mueller KR, Murtaugh MP, Hering BJ, Bonny C. Regulation of the JNK3 signaling pathway during islet isolation: JNK3 and c-fos as new markers of islet quality for transplantation. PLoS One. Jul. 1, 2014;9(7):e99796. doi: 10.1371/journal.pone.0099796. PubMed PMID: 24983249; PubMed Central PMCID: PMC4077704.
Abouaish J, Graham M, Bansal-Pakala P, Loganathan G, Soltani SM, Tiwari M, Yuasa T, Papas KK, Sutherland DE, McCarthy RC, Hering BJ, Balamurugan AN. Successful isolation and transplantation of nonhuman primate islets using a novel purified enzyme blend. Transplantation. Oct. 27, 2011;92(8):e40-2. doi: 10.1097/TP.0b013e318230157c. Erratum in: Transplantation. Aug. 15, 2013;96(3):e20. PubMed PMID: 21989272.
Abrahante JE, Martins K, Papas KK, Hering BJ, Schuurman HJ, Murtaugh MP. Microbiological safety of porcine islets: comparison with source pig. Xenotransplantation. Mar.-Apr. 2011;18(2):88-93. doi: 10.1111/j.1399-3089.2011.00632.x. PubMed PMID: 21496116.
Alejandro R, Barton FB, Hering BJ, Wease S; Collaborative Islet Transplant Registry Investigators. 2008 Update from the Collaborative Islet Transplant Registry. Transplantation. Dec. 27, 2008;86(12):1783-8. doi: 10.1097/TP.0b013e3181913f6a. PubMed PMID: 19104422.
Anazawa T, Balamurugan AN, Bellin M, Zhang HJ, Matsumoto S, Yonekawa Y, Tanaka T, Loganathan G, Papas KK, Beilman GJ, Hering BJ, Sutherland DE. Human islet isolation for autologous transplantation: comparison of yield and function using SERVA/Nordmark versus Roche enzymes. Am J Transplant. Oct. 2009;9(10):2383-91. doi: 10.1111/j.1600-6143.2009.02765.x. PubMed PMID: 19663895.

(56) References Cited

OTHER PUBLICATIONS

Anazawa T, Balamurugan AN, Matsumoto S, Lafreniere SA, O'Brien TD, Sutherland DE, Hering BJ. Rapid quantitative assessment of the pig pancreas biopsy predicts islet yield. Transplant Proc. Jul.-Aug. 2010;42(6):2036-9. doi: 10.1016/j.transproceed.2010.05.113. PubMed PMID: 20692401; PubMed Central PMCID: PMC2922853.

Anazawa T, Balamurugan AN, Papas KK, Avgoustiniatos ES, Ferrer J, Matsumoto S, Sutherland DE, Hering BJ. Improved method of porcine pancreas procurement with arterial flush and ductal injection enhances islet isolation outcome. Transplant Proc. Jul.-Aug. 2010;42(6):2032-5. doi: 10.1016/j.transproceed.2010.05.110. PubMed PMID: 20692400; PubMed Central PMCID: PMC2922859.

Anazawa T, Matsumoto S, Yonekawa Y, Loganathan G, Wilhelm JJ, Soltani SM, Papas KK, Sutherland DE, Hering BJ, Balamurugan AN. Prediction of pancreatic tissue densities by an analytical test gradient system before purification maximizes human islet recovery for islet autotransplantation/allotransplantation. Transplantation. Mar. 15, 2011;91(5):508-14. doi: 10.1097/TP.0b013e3182066ecb. PubMed PMID: 21169878.

Atchison N, Fan W, Brewer DD, Arunagirinathan MA, Hering BJ, Kumar S, Papas KK, Kokkoli E, Tsapatsis M. Silica-nanoparticle coatings by adsorption from lysine-silica-nanoparticle Sols on inorganic and biological surfaces. Angew Chem Int Ed Engl. Feb. 11, 2011;50(7):1617-21. doi: 10.1002/anie.201006231. PubMed PMID: 21308917.

Avgoustiniatos ES, Hering BJ, Papas KK. The rat pancreas is not an appropriate model for testing the preservation of the human pancreas with the two-layer method. Transplantation. May 27, 2006;81(10)1 471-2; author reply 1472. PubMed PMID: 16732188.

Avgoustiniatos ES, Hering BJ, Rozak PR, Wilson JR, Tempelman LA, Balamurugan AN, Welch DP, Weegman BP, Suszynski TM, Papas KK. Commercially available gas-permeable cell culture bags may not prevent anoxia in cultured or shipped islets. Transplant Proc. Mar. 2008;40(2):395-400. doi: 10.1016/j.transproceed.2008.01.059. PubMed PMID: 18374080; PubMed Central PMCID: PMC2764539.

Avgoustiniatos ES, Scott WE 3rd, Suszynski TM, Schuurman HJ, Nelson RA, Rozak PR, Mueller KR, Balamurugan AN, Ansite JD, Fraga DW, Friberg AS, Wildey GM, Tanaka T, Lyons CA, Sutherland DE, Hering BJ, Papas KK. Supplements in human islet culture: human serum albumin is inferior to fetal bovine serum. Cell Transplant. 2012;21(12):2805-14. doi: 10.3727/096368912X653138. PubMed PMID: 22863057.

Balamurugan AN, Breite AG, Anazawa T, Loganathan G, Wilhelm JJ, Papas KK, Dwulet FE, McCarthy RC, Hering BJ. Successful human islet isolation and transplantation indicating the importance of class 1 collagenase and collagen degradation activity assay. Transplantation. Apr. 27, 2010;89(8):954-61. doi: 10.1097/TP.0b013e3181d21e9a. PubMed PMID: 20300051.

Balamurugan AN, Green ML, Breite AG, Loganathan G, Wilhelm JJ, Tweed B, Vargova L, Lockridge A, Kuriti M, Hughes MG, Williams SK, Hering BJ, Dwulet FE, McCarthy RC. Identifying Effective Enzyme Activity Targets for Recombinant Class I and Class II Collagenase for Successful Human Islet Isolation. Transplant Direct. Dec. 23, 2015;2(1):e54. doi: 10.1097/TXD.0000000000000563. PubMed PMID: 27500247; PubMed Central PMCID: PMC4946501.

Balamurugan AN, Loganathan G, Bellin MD, Wilhelm JJ, Harmon J, Anazawa T, Soltani SM, Radosevich DM, Yuasa T, Tiwari M, Papas KK, McCarthy R, Sutherland DE, Hering BJ. A new enzyme mixture to increase the yield and transplant rate of autologous and allogeneic human islet products. Transplantation. Apr. 15, 2012;93(7):693-702. doi: 10.1097/TP.0b013e318247281b. PubMed PMID: 22318245; PubMed Central PMCID: PMC3314155.

Balamurugan AN, Naziruddin B, Lockridge A, Tiwari M, Loganathan G, Takita M, Matsumoto S, Papas K, Trieger M, Rainis H, Kin T, Kay TW, Wease S, Messinger S, Ricordi C, Alejandro R, Markmann J, Kerr-Conti J, Rickels MR, Liu C, Zhang X, Witkowski P, Posselt A, Maffi P, Secchi A, Berney T, O'Connell PJ, Hering BJ, Barton FB. Islet product characteristics and factors related to successful human islet transplantation from the Collaborative Islet Transplant Registry (CITR) 1999-2010. Am J Transplant. Nov. 2014;14(11):2595-606. doi: 10.1111/ajt.12872. PubMed PMID: 25278159; PubMed Central PMCID: PMC4282081.

Bartlett ST, Markmann JF, Johnson P, Korsgren O, Hering BJ, Scharp D, Kay TW, Bromberg J, Odorico JS, Weir GC, Bridges N, Kandaswamy R, Stock P, Friend P, Gotoh M, Cooper DK, Park CG, O'Connell P, Stabler C, Matsumoto S, Ludwig B, Choudhary P, Kovatchev B, Rickels MR, Sykes M, Wood K, Kraemer K, Hwa A, Stanley E, Ricordi C, Zimmerman M, Greenstein J, Montanya E, Otonkoski T. Report from IPITA-TTS Opinion Leaders Meeting on the Future of β-Cell Replacement. Transplantation. Feb. 2016100 Suppl 2:S1-44. doi: 10.1097/TP.0000000000001055. PubMed PMID: 26840096; PubMed Central PMCID: PMC4741413.

Barton FB, Rickels MR, Alejandro R, Hering BJ, Wease S, Naziruddin B, Oberholzer J, Odorico JS, Garfinkel MR, Levy M, Pattou F, Berney T, Secchi A, Messinger S, Senior PA, Maffi P, Posselt A, Stock PG, Kaufman DB, Luo X, Kandeel F, Cagliero E, Turgeon NA, Witkowski P, Naji A, O'Connell PJ, Greenbaum C, Kudva YC, Brayman KL, Aull MJ, Larsen C, Kay TW, Fernandez LA, Vantyghem MC, Bellin M, Shapiro AM. Improvement in outcomes of clinical islet transplantation: 1999-2010. Diabetes Care. Jul. 2012;35(7):1436-45. doi: 10.2337/dc12-0063. PubMed PMID: 22723582; PubMed Central PMCID: PMC3379615.

Bellin MD, Barton FB, Heitman A, Harmon JV, Kandaswamy R, Balamurugan AN, Sutherland DE, Alejandro R, Hering BJ. Potent induction immunotherapy promotes long-term insulin independence after islet transplantation in type 1 diabetes. Am J Transplant. Jul. 2012;12(6):1576-83. doi: 10.1111/j.1600-6143.2011.03977.x. PubMed PMID: 22494609; PubMed Central PMCID: PMC3390261.

Bellin MD, Beilman GJ, Dunn TB, Pruett TL, Chinnakotla S, Wilhelm JJ, Ngo A, Radosevich DM, Freeman ML, Schwarzenberg SJ, Balamurugan AN, Hering BJ, Sutherland DE. Islet autotransplantation to preserve beta cell mass in selected patients with chronic pancreatitis and diabetes mellitus undergoing total pancreatectomy. Pancreas. Mar. 2013;42(2):317-21. doi: 10.1097/MPA.0b013e3182681182. PubMed PMID: 23146918; PubMed Central PMCID: PMC3573248.

Bellin MD, Beilman GJ, Dunn TB, Pruett TL, Sutherland DE, Chinnakotla S, Hodges JS, Lane A, Ptacek P, Berry KL, Hering BJ, Moran A. Sitagliptin Treatment After Total Pancreatectomy With Islet Autotransplantation: A Randomized, Placebo-Controlled Study. Am J Transplant. Feb. 2017;17(2):443-450. doi: 10.1111/ajt.13979. PubMed PMID: 27459721; PubMed Central PMCID: PMC5266635.

Bellin MD, Carlson AM, Kobayashi T, Gruessner AC, Hering BJ, Moran A, Sutherland DE. Outcome after pancreatectomy and islet autotransplantation in a pediatric population. J Pediatr Gastroenterol Nutr. Jul. 2008;47(1):37-44. doi: 10.1097/MPG.0b013e31815cbaf9. PubMed PMID: 18607267.

Bellin MD, Clark P, Usmani-Brown S, Dunn TB, Beilman GJ, Chinnakotla S, Pruett TL, Ptacek P, Hering BJ, Wang Z, Gilmore T, Wilhelm JJ, Hodges JS, Moran A, Herold KC. Unmethylated Insulin DNA Is Elevated After Total Pancreatectomy With Islet Autotransplantation: Assessment of a Novel Beta Cell Marker. Am J Transplant. Sep. 19, 2016. doi: 10.1111/ajt.14054. [Epub ahead of print] PubMed PMID: 27643615.

Bellin MD, Kandaswamy R, Parkey J, Zhang HJ, Liu B, Ihm SH, Ansite JD, Witson J, Bansal-Pakala P, Balamurugan AN, Papas KK, Sutherland DE, Moran A, Hering BJ. Prolonged insulin independence after islet allotransplants in recipients with type 1 diabetes. Am J Transplant. Nov. 2008;8(11):2463-70. doi: 10.1111/j.1600-6143.2008.02404.x. Erratum in: Am J Transplant. May 2010;10(5):1337. Papas, K [corrected to Papas, K K]. PubMed PMID: 18808408; PubMed Central PMCID: PMC4312281.

Bellin MD, Sutherland DE, Beilman GJ, Hong-McAtee I, Balamurugan AN, Hering BJ, Moran A. Similar islet function in islet allotransplant and autotransplant recipients, despite lower islet

(56) References Cited

OTHER PUBLICATIONS mass in autotransplants. Transplantation. Feb. 15, 2011;91(3):367-72. doi: 10.1097/TP.0b013e318203fd09. PubMed PMID: 21228753.

Berg T, Wu T, Levay-Young B, Heuss N, Pan Y, Kirchhof N, Sutherland DE, Hering BJ, Guo Z. Comparison of tolerated and rejected islet grafts: a gene expression study. Cell Transplant. 2004;13(6):619-29. PubMed PMID: 15648732.

Bongoni AK, Kiermeir D, Denoyelle J, Jenni H, Burlak C, Seebach JD, Vögelin E, Constantinescu MA, Rieben R. Porcine extrahepatic vascular endothelial asialoglycoprotein receptor 1 mediates xenogeneic platelet phagocytosis in vitro and in human-to-pig ex vivo xenoperfusion. Transplantation. Apr. 2015;99(4):693-701. doi: 10.1097/TP.0000000000000553. PubMed PMID: 25675194.

Brandhorst D, Brandhorst H, Hering BJ, Bretzel RG. Long-term survival, morphology and in vitro function of isolated pig islets under different culture conditions. Transplantation. Jun. 27, 1999;67(12):1533-41. PubMed PMID: 10401759.

Brandhorst D, Brandhorst H, Hering BJ, Eckhard T, Jahr H, Federlin K, Bretzel RG. ATP content of isolated islets: indication for species-dependent vulnerability for cell-mediated graft rejection? Transplant Proc. Jun. 1997;29(4):2058. PubMed PMID: 9193524.

Brandhorst D, Brandhorst H, Hering BJ, Federlin K, Bretzel RG. Islet isolation from the pancreas of large mammals and humans: 10 years of experience. Exp Clin Endocrinol Diabetes. 1995;103 Suppl 2:3-14. PubMed PMID: 8839246.

Brandhorst D, Brandhorst H, Hering BJ, Federlin K, Bretzel RG. Isolated porcine pancreatic islets in long-term culture: effects of temperature on survival, viability, and function of islets. Transplant Proc. Dec. 1995;27(6):3339. PubMed PMID: 8539980.

Brandhorst D, Brandhorst H, Hering BJ, Federlin K, Bretzel RG. Large variability of the intracellular ATP content of human islets isolated from different donors. J Mol Med (Berl). Jan. 1999;77(1):93-5. PubMed PMID: 9930937.

Brandhorst D, Brandhorst H, Hering BJ, Federlin K, Bretzel RG. The intracellular ATP content of fresh and cultured human islets isolated from different donors. Transplant Proc. Jun. 1997;29(4):1979. PubMed 9193487.

Brandhorst D, Hering BJ, Brandhorst H, Federlin K, Bretzel RG. Body mass index is an important determinant for human islet isolation outcome. Transplant Proc. Dec. 1994;26(6):3529-30. PubMed PMID: 7998263.

Brandhorst D, Hering BJ, Brandhorst H, Federlin K, Bretzel RG. Effects of bicarbonate and amino acid buffered media on survival and viability of long-term bulk cultured human islets. Transplant Proc. Dec. 1995;27(6):3337-8. PubMed PMID: 8539979.

Brandhorst D, Hering BJ, Brandhorst H, Federlin K, Bretzel RG. Influence of donor data and organ procurement on human islet isolation. Transplant Proc. Apr. 1994;26(2):592-3. PubMed PMID: 7513457.

Brandhorst D, Hering BJ, Brandhorst H, Kirchhof N, Dzapo V, Federlin K, Bretzel RG. Dietary treatment with soybean oil improves porcine islet culture and reduces islet immunogenicity. Transplant Proc. Apr. 1994;26(2):613. PubMed PMID: 8171580.

Brandhorst H, Brandhorst D, Brendel MD, Hering BJ, Bretzel RG. Assessment of intracellular insulin content during all steps of human islet isolation procedure. Cell Transplant. Sep.-Oct. 1998;7(5):489-95. PubMed PMID: 9786069.

Brandhorst H, Brandhorst D, Brendel MD, Hering BJ, Bretzel RG. Monitoring of insulin content during human islet isolation. Transplant Proc. Mar. 1998;30(2):364-5. PubMed PMID: 9532081.

Brandhorst H, Brandhorst D, Hering BJ, Bretzel RG. Significant progress in porcine islet mass isolation utilizing liberase HI for enzymatic low-temperature pancreas digestion. Transplantation. Aug. 15, 1999;68(3):355-61. PubMed PMID: 10459538.

Brandhorst H, Brandhorst D, Hering BJ, Federlin K, Bretzel RG. Body mass index of pancreatic donors: a decisive factor for human islet isolation. Exp Clin Endocrinol Diabetes. 1995;103 Suppl 2:23-26. PubMed PMID: 8839248.

Brandhorst H, Brandhorst D, Hering BJ, Federlin K, Bretzel RG. In vitro glucose sensitivity of cultured human and porcine islets. Transplant Proc. Jun. 1997;29(4):1980-1. PubMed PMID: 9193488.

Brandhorst H, Brandhorst D, Lau D, Hering BJ, Federlin K, Bretzel RG. Glucose sensitivity of porcine and human islets in vitro. J Mol Med (Berl). Jan. 1999;77(1):90-2. PubMed PMID: 9930936.

Brandhorst H, Hering BJ, Brandhorst D, Federlin K, Bretzel RG. Impact of cold ischemia and timing of intraductal collagenase distension on human islet yield, purity, viability, and survival in low temperature culture. Transplant Proc. Apr. 1994;26(2):590-1. PubMed PMID: 8171572.

Brandhorst H, Hering BJ, Brandhorst D, Hiller WF, Gubernatis G, Federlin K, Bretzel RG. Comparison of histidine-tryptophane-ketoglutarate (HTK) and University of Wisconsin (UW) solution for pancreas perfusion prior to islet isolation, culture and transplantation. Transplant Proc. Dec. 1995;27(6):3175-6. PubMed PMID: 8539896.

Bretzel RG, Alejandro R, Hering BJ, van Suylichem PT, Ricordi C. Clinical islet transplantation: guidelines for islet quality control. Transplant Proc. Apr. 1994;26(2):388-92. PubMed PMID: 8171472.

Bretzel RG, Brandhorst D, Brandhorst H, Eckhard M, Ernst W, Friemann S, Rau W, Weimar B, Rauber K, Hering BJ, Brendel MD. Improved survival of intraportal pancreatic islet cell allografts in patients with type-1 diabetes mellitus by refined peritransplant management. J Mol Med (Berl). Jan. 1999;77(1):140-3. PubMed PMID: 9930949.

Bretzel RG, Flesch BK, Brennenstuhl G, Greiner I, Hering BJ, Woehrle M, Federlin K. Rat pancreatic islet pretreatment with anti-MHC class II monoclonal antibodies and culture: in vitro MLIC test response does not predict islet allograft survival. Acta Diabetol. 1993;30(1):49-56. PubMed PMID: 8329731.

Bretzel RG, Flesch BK, Hering BJ, Brendel M, Klitscher D, Brandhorst H, Schelz J, Munch KP, Federlin K. Impact of culture and cryopreservation on MHC class II antigen expression in canine and porcine islets. Horm Metab Res Suppl. 1990;25:128-32. PubMed PMID: 2088952.

Bretzel RG, Hering BJ, Federlin K. Islet transplantation in diabetes mellitus. Contrib Nephrol. 1989;73:217-26; discussion 226-8. Review. PubMed PMID: 2513167.

Bretzel RG, Hering BJ, Federlin KF. Islet cell transplantation in diabetes mellitus—from bench to bedside. Exp Clin Endocrinol Diabetes. 1995;103 Suppl 2:143-59. Review. PubMed PMID: 8839273.

Burlak C, Bern M, Brito AE, Isailovic D, Wang ZY, Estrada JL, Li P, Tector AJ. N-linked glycan profiling of GGTA1/CMAH knockout pigs identifies new potential carbohydrate xenoantigens. Xenotransplantation. Sep.-Oct. 2013;20(5):277-91. doi: 10.1111/xen.12047. PubMed PMID: 24033743; PubMed Central PMCID: PMC4593510.

Burlak C, Chakrabarti S. Xenotransplantation literature update, Jul.-Aug. 2015. Xenotransplantation. Sep.-Oct. 2015;22(5):408-10. doi: 10.1111/xen.12197. Review. PubMed PMID: 26315287.

Burlak C, Hoang QQ. Xenotransplantation literature update, May-Jun. 2014. Xenotransplantation. Jul.-Aug. 2014;21(4):392-5. doi: 10.1111/xen.12128. Review. PubMed PMID: 25041534.

Burlak C, Kerns K, Taylor RT. Xenotransplantation literature update, Mar.-Apr. 2015. Xenotransplantation. May-Jun. 2015;22(3):236-8. doi: 10.1111/xen.12171. Review. PubMed PMID: 25988427.

Burlak C, Kerns KC. Xenotransplantation literature update, Jan.-Feb. 2015. Xenotransplantation. Mar.-Apr. 2015;22(2):155-7. doi: 10.1111/xen.12168. Review. PubMed PMID: 25801425.

Burlak C, Mueller KR, Beaton BP. Xenotransplantation literature update, May-Jun. 2015. Xenotransplantation. Jul.-Aug. 2015;22(4):325-7. doi: 10.1111/xen.12181. Review. PubMed PMID: 26179327.

Burlak C, Paris LL, Chihara RK, Sidner RA, Reyes LM, Downey SM, Tector AJ. The fate of human platelets perfused through the pig liver: implications for xenotransplantation. Xenotransplantation. Sep.-Oct. 2010;17(5):350-61. doi: 10.1111/0399-3089.2010.00605.x. PubMed PMID: 20955292.

(56) References Cited

OTHER PUBLICATIONS

Burlak C, Taylor RT. Xenotransplantation literature update, Jul.-Aug. 2014. Xenotransplantation. Sep.-Oct. 2014;21(5):482-4. doi: 10.1111/xen.12144. Review. PubMed PMID: 25250866.
Burlak C, Taylor RT. Xenotransplantation literature update, Mar.-Apr. 2014. Xenotransplantation. May-Jun. 2014;21(3):301-5. doi: 10.1111/xen.12112. Review. PubMed PMID: 24894205.
Burlak C, Taylor TR. Xenotransplantation literature update, Sep.-Oct. 2015. Xenotransplantation. Nov.-Dec. 2015;22(6):490-2. doi: 10.1111/xen.12216. Review. PubMed PMID: 26669726.
Burlak C, Twining LM, Rees MA. Carbohydrates borne on human glycophorin A are recognized by porcine Kupffer cells. Transplantation. Jul. 15, 2005;80(1):66-74. PubMed PMID: 16003235.
Burlak C, Twining LM, Rees MA. Terminal sialic acid residues on human glycophorin A are recognized by porcine kupffer cells. Transplantation. Aug. 15, 2005;80(3):344-52. PubMed PMID: 16082330.
Burlak C, Wang Zy, Chihara RK, Lutz AJ, Wang Y, Estrada JL, Tector AJ. Identification of human preformed antibody targets in GTKO pigs. Xenotransplantation. Mar.-Apr. 2012;19(2):92-101. doi: 10.1111/j.1399-3089.2012.00695.x. PubMed PMID: 22497511.
Burlak C, Wilhelm JJ. Xenotransplantation literature update, Sep.-Oct. 2014. Xenotransplantation. Nov.-Dec. 2014;21(6):584-7. doi: 10.1111/xen.12147. Review. PubMed PMID: 25382197.
Burlak C. Xenotransplantation literature update, Jan.-Feb. 2014. Xenotransplantation. Mar.-Apr. 2014;21(2):196-9. doi: 10.1111/xen.12105. Review. PubMed PMID: 25268251.
Burlak C. Xenotransplantation literature update, Jan.-Feb. 2016. Xenotransplantation. Mar. 2016;23(2):168-70. doi: 10.1111/xen.12237. PubMed PMID: 27106873.
Burlak C. Xenotransplantation literature update, Jul.-Aug. 2016. Xenotransplantation. Sep. 2016;23(5):421-2. doi: 10.1111/xen.12273. PubMed PMID: 27659665.
Burlak C. Xenotransplantation literature update, Mar.-Apr. 2016. Xenotransplantation. May 2016;23(3):249-50. doi: 10.1111/xen.12241. PubMed PMID: 27238656.
Burlak C. Xenotransplantation literature update, May-Jun. 2016. Xenotransplantation. Jul. 2016;23(4):330-1. doi: 10.1111/xen.12256. PubMed PMID: 27456072.
Burlak C. Xenotransplantation literature update, Nov.-Dec. 2014. Xenotransplantation. Jan.-Feb. 2015;22(1):80-3. doi: 10.1111/xen.12158. Review. PubMed PMID: 25676364.
Burlak C. Xenotransplantation literature update, Nov.-Dec. 2015. Xenotransplantation. Jan.-Feb. 2016;23(1):77-9. doi: 10.1111/xen.12221. PubMed PMID: 26850936.
Cardona K, Milas Z, Strobert E, Cano J, Jiang W, Safley SA, Gangappa S, Hering BJ, Weber CJ, Pearson TC, Larsen CP. Engraftment of adult porcine islet xenografts in diabetic nonhuman primates through targeting of costimulation pathways. Am J Transplant. Oct. 2007;7(10):2260-8. PubMed PMID: 17845561.
Chihara RK, Lutz AJ, Paris Ll, Wang ZY, Sidner RA, Heyrman AT, Downey SM, Burlak C, Tector AJ. Fibronectin from alpha 1,3-galactosyltransferase knockout pigs is a xenoantigen. J Surg Res. Oct. 2013;184(2):1123-33. doi: 10.1016/j.jss.2013.04.012. PubMed PMID: 23673165.
Chihara RK, Paris LL, Reyes LM, Sidner RA, Estrada JL, Downey SM, Wang ZY, Tector AJ, Burlak C. Primary porcine Kupffer cell phagocytosis of human platelets involves the CD18 receptor. Transplantation. Oct. 15, 2011;92(7):739-44. doi: 10.1097/TP.0b013e31822bc986. PubMed PMID: 21836538.
Chinnakotla S, Beilman GJ, Dunn TB, Bellin MD, Freeman ML, Radosevich DM, Arain M, Amateau SK, Mallery JS, Schwarzenberg SJ, Clavel A, Wilhelm J, Robertson RP, Berry L, Cook M, Hering BJ, Sutherland DE, Pruett TL. Factors Predicting Outcomes After a Total Pancreatectomy and Islet Autotransplantation Lessons Learned From Over 500 Cases. Ann Surg. Oct. 2015;262(4):610-22. doi: 10.1097/SLA.0000000000001453. PubMed PMID: 26366540.
Chinnakotla S, Bellin MD, Schwarzenberg SJ, Radosevich DM, Cook M, Dunn TB, Beilman GJ, Freeman ML, Balamurugan AN, Wilhelm J, Bland B, Jimenez-Vega JM, Hering BJ, Vickers SM, Pruett TL, Sutherland DE. Total pancreatectomy and islet autotransplantation in children for chronic pancreatitis: indication, surgical techniques, postoperative management, and long-term outcomes. Ann Surg. Jul. 2014;260(1):56-64. doi: 10.1097/SLA.0000000000000569. PubMed PMID: 24509206; PubMed Central PMCID: PMC4124084.
CITR Research Group. 2007 update on allogeneic islet transplantation from the Collaborative Islet Transplant Registry (CITR). Cell Transplant. 2009;18(7):753-67. doi: 10.3727/096368909X470874. PubMed PMID: 19796497.
Close NC, Hering BJ, Anand R, Eggerman TL; CITR Research Group. Collaborative ilslet Transplant Registry. Clin Transpl. 2003:109-18. PubMed PMID: 15387102.
Close NC, Hering BJ, Eggerman TL. Results from the inaugural year of the Collaborative Islet Transplant Registry. Transplant Proc. Mar. 2005;37(2):1305-8. PubMed PMID: 15848704.
Cooper DK, Ekser B, Burlak C, Ezzelarab M, Hara H, Paris L, Tector AJ, Phelps C, Azimzadeh AM, Ayares D, Robson SC, Pierson RN 3rd. Clinical lung xenotransplantation—what donor genetic modifications may be necessary? Xenotransplantation. May-Jun. 2012;19(3):144-58. doi: 10.1111/j.1399-3089.2012.00708.x. Review. PubMed PMID: 22702466; PubMed Central PMCID: PMC3775598.
Cozzi E, Tönjes RR, Gianello P, Bühler LH, Rayat GR, Matsumoto S, Park CG, Kwon I, Wang W, O'Connell P, Jessamine S, Elliott RB, Kobayashi T, Hering BJ. First update of the International Xenotransplantation Association consensus statement on conditions for undertaking clinical trials of porcine islet products in type 1 diabetes—Chapter 1: update on national regulatory frameworks pertinent to clinical islet xenotransplantation. Xenotransplantation. Jan.-Feb. 2016;23(1):14-24. doi: 10.1111/xen.12222. PubMed PMID: 26940509.
Dvorak CM, Hårdstedt M, Xie H, Wang M, Papas KK, Hering BJ, Murtaugh MP, Fahrenkrug SC. Transcriptional profiling of stress response in cultured porcine islets. Biochem Biophys Res Commun. May 25, 2007;357(1):118-25. PubMed PMID: 17407763.
Ekser B, Burlak C, Waldman JP, Lutz AJ, Paris LL, Veroux M, Robson SC, Rees MA, Ayares D, Gridelli B, Tector AJ, Cooper DK. Immunobiology of liver xenotransplantation. Expert Rev Clin Immunol. Sep. 2012;8(7):621-34. doi: 10.1586/eci.12.56. Review. PubMed PMID: 23078060; PubMed Central PMCID: PMC3774271.
El-Ouaghlidi A, Jahr H, Pfeiffer G, Hering BJ, Brandhorst D, Brandhorst H, Federlin K, Bretzel RG. Cytokine mRNA expression in peripheral blood cells of immunosuppressed human islet transplant recipients. J Mol Med (Berl). Jan. 1999;77(1):115-7. PubMed PMID: 9930942.
El-Ouaghlidi A, Jahr H, Pfeiffer G, Hering BJ, Federlin K, Bretzel RG. Cytokine transcripts in peripheral blood cells during immunosuppressive induction therapy in allogeneic human islet transplantation. Transplant Proc. Jun. 1997;29(4):2154. PubMed PMID: 9193567.
Farney AC, Hering BJ, Nelson L, Tanioka Y, Gilmore T, Leone J, Wahoff D, Najarian J, Kendall D, Sutherland DE. No late failures of intraportal human islet autografts beyond 2 years. Transplant Proc. Mar. 1998;30(2):420. PubMed PMID: 9532109.
Federlin K, Bretzel RG, Hering BJ. Recent achievements in experimental and clinical islet transplantation. Diabet Med. Jan. 1991;8(1):5-12. Review. PubMed PMID: 1826246.
Federlin KF, Bretzel RG, Hering BJ. [Experimental and clinical islets transplantation. Current status]. Zentralbl Chir. 1992;117(12):670-6. Review. German. PubMed PMID: 1285474.
Fehmann HC, Hering BJ, Wolf MJ, Brandhorst H, Brandhorst D, Bretzel RG, Federlin K, Goke B. The effects of glucagon-like peptide-I (GLP-I) on hormone secretion from isolated human pancreatic islets. Pancreas. Aug. 1995;11(2):196-200. PubMed PMID: 7479679.
Ferrer J, Scott WE 3rd, Weegman BP, Suszynski TM, Sutherland DE, Hering BJ, Papas KK. Pig pancreas anatomy: implications for pancreas procurement, preservation, and islet isolation. Transplan-

(56) References Cited

OTHER PUBLICATIONS tation. Dec. 15, 2008;86(11):1503-10. doi: 10.1097/TP. 0b013e31818bfda1. PubMed PMID: 19077881; PubMed Central PMCID: PMC2704055.

Gebauer BS, Hricik DE, Atallah A, Bryan K, Riley J, Tary-Lehmann M, Greenspan NS, Dejelo C, Boehm BO, Hering BJ, Heeger PS. Evolution of the enzyme-linked immunosorbent spot assay for post-transplant alloreactivity as a potentially useful immune monitoring tool. Am J Transplant. Oct. 2002;2(9):857-66. PubMed PMID: 12392292.

Gianani R, Campbell-Thompson M, Sarkar SA, Wasserfall C, Pugliese A, Solis JM, Kent SC, Hering BJ, West E, Steck A, Bonner-Weir S, Atkinson MA, Coppieters K, von Herrath M, Eisenbarth GS. Dimorphic histopathology of long-standing childhood-onset diabetes. Diabetologia. Apr. 2010;53(4):690-8. doi: 10.1007/500125-009-1642-y. Erratum in: Diabetologia. Aug. 2010;53(8):1811-2. PubMed PMID: 20062967.

Gibly RF, Graham JG, Luo X, Lowe WL Jr, Hering BJ, Shea LD. Advancing islet transplantation: from engraftment to the immune response. Diabetologia. Oct. 2011;54(10):2494-505. doi: 10.1007/s00125-011-2243-0. Review. PubMed PMID: 21830149; PubMed Central PMCID: PMC3193607.

Gibly RF, Zhang X, Graham ML, Hering BJ, Kaufman DB, Lowe WL Jr, Shea LD. Extrahepatic islet transplantation with microporous polymer scaffolds in syngeneic mouse and allogeneic porcine models. Biomaterials. Dec. 2011;32(36):9677-84. doi: 10.1016/j.biomaterials.2011.08.084. PubMed PMID: 21959005; PubMed Central PMCID: PMC3195897.

Graham ML, Bellin MD, Papas KK, Hering BJ, Schuurman HJ. Species incompatibilities in the pig-to-macaque islet xenotransplant model affect transplant outcome: a comparison with allotransplantation. Xenotransplantation. Nov.-Dec. 2011;18(6):328-42. doi: 10.1111/j.1399-3089.2011.00676.x. PubMed PMID: 22168140.

Graham ML, Mutch LA, Rieke EF, Kittredge JA, Faig AW, DuFour TA, Munson JW, Zolondek EK, Hering BJ, Schuurman HJ. Refining the high-dose streptozotocin-induced diabetic non-human primate model: an evaluation of risk factors and outcomes. Exp Biol Med (Maywood). Oct. 2011;236(10):1218-30. doi: 10.1258/ebm.2011.011064. PubMed PMID: 21917592.

Graham ML, Rieke EF, Wijkstrom M, Dunning M, Aasheim TC, Graczyk MJ, Pilon KJ, Hering BJ. Risk factors associated with surgical site infection and the development of short-term complications in macaques undergoing indwelling vascular access port placement. J Med Primatol. Aug. 2008;37(4):202-9. doi: 10.1111/j.1600-0684.2008.00281.x. PubMed PMID: 18331559.

Gramberg D, Ernst E, Liu X, Kirchhof N, Hering BJ, Bretzel RG, Federlin K. Isokinetic gradients decrease islet graft immunogenicity. Transplant Proc. Apr. 1994;26(2):753. PubMed PMID: 8171645.

Gröhn P, Klöck G, Schmitt J, Zimmermann U, Horcher A, Bretzel RG, Hering BJ, Brandhorst D, Brandhorst H, Zekorn T, et al. Large-scale production of Ba(2+)-alginate-coated islets of Langerhans for immunoisolation. Exp Clin Endocrinol. 1994;102(5):380-7. PubMed PMID: 7867701.

Groth CG, Hering BJ, Geier C, Bretzel RG, Federlin K. Immunosuppression in pancreatic islet cell transplantation. Transplant Proc. Oct. 1994;26(5):2756. PubMed PMID: 7940867.

Gruessner RW, Sutherland DE, Dunn DL, Najarian JS, Jie T, Hering BJ, Gruessner AC. Transplant options for patients undergoing total pancreatectomy for chronic pancreatitis. J Am Coll Surg. Apr. 2004;198(4):559-67; discussion 568-9. PubMed PMID: 15051008.

Guo Z, Wu T, Kirchhof N, Mital D, Williams JW, Azuma M, Sutherland DE, Hering BJ. Immunotherapy with nondepleting anti-CD4 monoclonal antibodies but not CD28 antagonists protects islet graft in spontaneously diabetic nod mice from autoimmune destruction and allogeneic and xenogeneic graft rejection. Transplantation. Jun. 15, 2001;71(11):1656-65. PubMed PMID: 11435979.

Guo Z, Wu T, Sozen H, Pan Y, Heuss N, Kalscheuer H, Sutherland DE, Blazar BR, Hering BJ. A substantial level of donor hematopoietic chimerism is required to protect donor-specific islet grafts in diabetic NOD mice. Transplantation. Apr. 15, 2003;75(7):909-15. PubMed PMID: 12698073.

Hecht G, Eventov-Friedman S, Rosen C, Shezen E, Tchorsh D, Aronovich A, Freud E, Golan H, El-Hasid R, Katchman H, Hering BJ, Zung A, Kra-Oz Z, Shaked-Mishan P, Yusim A, Shtabsky A, Idelevitch P, Tobar A, Harmelin A, Bachar-Lustig E, Reisner Y. Embryonic pig pancreatic tissue for the treatment of diabetes in a nonhuman primate model. Proc Natl Acad Sci U S A. May 26, 2009;106(21):8659-64. doi: 10.1073/pnas.0812253106. PubMed PMID: 19433788; PubMed Central PMCID: PMC2688963.

Hering BJ. Achieving and maintaining insulin independence in human islet transplant recipients. Transplantation. May 27, 2005;79(10):1296-7. PubMed PMID: 15912092.

Hering BJ, Bellin MD. Transplantation: Sustained benefits of islet transplants for T1DM. Nat Rev Endocrinol. Oct. 2015;11(10):572-4. doi: 10.1038/nrendo.2015.126. PubMed PMID: 26239608.

Hering BJ, Bretzel RG, Federlin K. Current status of clinical islet transplantation. Horm Metab Res. Sep. 1988;20(9):537-45. Review. PubMed PMID: 3143652.

Hering BJ, Bretzel RG, Hopt UT, Brandhorst H, Brandhorst D, Bollen CC, Raptis G, Helf F, Grossmann R, Mellert J, et al. New protocol toward prevention of early human islet allograft failure. Transplant Proc. Apr. 1994;26(2):570-1. PubMed PMID: 8171558.

Hering BJ, Browatzki CC, Schultz A, Bretzel RG, Federlin KF. Clinical islet transplantation—registry report, accomplishments in the past and future research needs. Cell Transplant. Jul.-Aug. 1993;2(4):269-82; discussion 283-305. Review. PubMed PMID: 8162271.

Hering BJ, Browatzki CC, Schultz AO, Bretzel RG, Federlin K. Islet Transplant Registry report on adult and fetal islet allografts. Transplant Proc. Apr. 1994;26(2):565-8. PubMed PMID: 8171556.

Hering BJ, Clarke WR, Bridges ND, Eggerman TL, Alejandro R, Bellin MD, Chaloner K, Czarniecki CW, Goldstein JS, Hunsicker LG, Kaufman DB, Korsgren O, Larsen CP, Luo X, Markmann JF, Naji A, Oberholzer J, Posselt AM, Rickels MR, Ricordi C, Robien MA, Senior PA, Shapiro AM, Stock PG, Turgeon NA; Clinical Islet Transplantation Consortium. Phase 3 Trial of Transplantation of Human Islets in Type 1 Diabetes Complicated by Severe Hypoglycemia. Diabetes Care. Jul. 2016;39(7):1230-40. doi: 10.2337/dc15-1988. PubMed PMID: 27208344.

Hering BJ, Cooper DK, Cozzi E, Schuurman HJ, Korbutt GS, Denner J, O'Connell PJ, Vanderpool HY, Pierson RN 3rd. The International Xenotransplantation Association consensus statement on conditions for undertaking clinical trials of porcine islet products in type 1 diabetes—executive summary. Xenotransplantation. Jul.-Aug. 2009;16(4):196-202. doi: 10.1111/j.1399-3089.2009.00547.x. PubMed PMID: 19799759.

Hering BJ, Cozzi E, Spizzo T, Cowan PJ, Rayat GR, Cooper DK, Denner J. First update of the International Xenotransplantation Association consensus statement on conditions for undertaking clinical trials of porcine islet products in type 1 diabetes—Executive summary. Xenotransplantation. Jan.-Feb. 2016;23(1):3-13. doi: 10.1111/xen.12231. PubMed PMID: 26940725.

Hering BJ, Gramberg D, Ernst E, Kirchhof N, Bretzel RG, Federlin K. Isokinetic gradients: a new approach to reduce islet graft immunogenicity. Transplant Proc. Feb. 1993;25(1 Pt 2):959-60. PubMed PMID: 8442279.

Hering BJ, Kandaswamy R, Ansite JD, Eckman PM, Nakano M, Sawada T, Matsumoto I, Ihm SH, Zhang HJ, Parkey J, Hunter DW, Sutherland DE. Single-donor, marginal-dose islet transplantation in patients with type 1 diabetes. JAMA. Feb. 16, 2005;293(7):830-5. Erratum in: JAMA. Apr. 6, 2005;293(13):1594. PubMed PMID: 15713772.

Hering BJ, Kandaswamy R, Harmon JV, Ansite JD, Clemmings SM, Sakai T, Paraskevas S, Eckman PM, Sageshima J, Nakano M, Sawada T, Matsumoto I, Zhang HJ, Sutherland DE, Bluestone JA. Transplantation of cultured islets from two-layer preserved pancreases in type 1 diabetes with anti-CD3 antibody. Am J Transplant. Mar. 2004;4(3):390-401. PubMed PMID: 14961992.

Hering BJ, Matsumoto I, Sawada T, Nakano M, Sakai T, Kandaswamy R, Sutherland DE. Impact of two-layer pancreas preservation on islet isolation and transplantation. Transplantation. Dec. 27, 2002;74(12):1813-6. Review. PubMed PMID: 12499907.

(56) References Cited

OTHER PUBLICATIONS

Hering BJ, O'Connell PJ. First update of the International Xenotransplantation Association consensus statement on conditions for undertaking clinical trials of porcine islet products in type 1 diabetes—Chapter 6: patient selection for pilot clinical trials of islet xenotransplantation. Xenotransplantation. Jan.-Feb. 2016;23(1):60-76. doi: 10.1111/xen.12228. PubMed PMID: 26918540.
Hering BJ. Repurification: rescue rather than routine remedy. Am J Transplant. Jan. 2005;5(1):1-2. PubMed PMID: 15636604.
Hering BJ, Romann D, Clarius A, Brendel M, Slijepcevic M, Bretzel RG, Federlin K. Bovine islets of Langerhans. Potential source for transplantation? Diabetes. Jan. 1989;38 Suppl 1:206-8. PubMed PMID: 2492006.
Hering BJ, Sykes M, Sutherland DE, Shapiro AM, Tremblay JP. The first Joint Conference of the Cell Transplant Society (CTS), International Pancreas and Islet Transplant Association (IPITA), and International Xenotransplantation Association (IXA), all sections of The Transplantation Society (TTS), took place in Minneapolis, Minn, USA, from Sep. 15-20, 2007. Preface. Transplant Proc. Mar. 2008;40(2):335-6. doi: 10.1016/j.transproceed.2008.02.021. PubMed PMID: 18374060.
Hering BJ, Walawalkar N. Pig-to-nonhuman primate islet xenotransplantation. Transpl Immunol. Jun. 2009;21(2):81-6. doi: 10.1016/j.trim.2009.05.001. Review. PubMed PMID: 19427901.
Hering BJ, Wijkstrom M, Graham ML, HArdstedt M, Aasheim TC, Jie T, Ansite JD, Nakano M, Cheng J, Li W, Moran K, Christians U, Finnegan C, Mills CD, Sutherland DE, Bansal-Pakala P, Murtaugh MP, Kirchhof N, Schuurman HJ. Prolonged diabetes reversal after intraportal xenotransplantation of wild-type porcine islets in immunosuppressed nonhuman primates. Nat Med. Mar. 2006;12(3):301-3. PubMed PMID: 16491083.
Hering BJ, Wijkstrom M. Sirolimus and islet transplants. Transplant Proc. May 2003;35(3 Suppl):1875-1905. Review. PubMed PMID: 12742495.
Hesse UJ, Hering BJ, Bretzel RG, Brandhorst H, Brandhorst D, De Looze D, Federlin K, Elewaut A, de Hemptinne B. Efficiency of highly purified islets autotransplanted into the portal vein after total pancreatectomy. Transplant Proc. Dec. 1994;26(6):3525-6. PubMed PMID: 7998261.
Hiraoka K, Trexler A, Eckman E, Stage A, Nevile S, Sageshima J, Shibata S, Sutherland DE, Hering BJ. Successful pancreas preservation before islet isolation by the simplified two-layer cold storage method. Transplant Proc. Feb.-Mar. 2001;33(1-2):952-3. PubMed PMID: 11267141.
Hiraoka K, Trexler A, Fujioka B, Guo Z, Zhang HJ, Overland A, Oberbroeckling J, Sageshima J, Shibata S, Sutherland DE, Hering BJ. Optimal temperature in pancreas preservation by the two-layer cold storage method before islet isolation. Transplant Proc. Feb.-Mar. 2001;33(1-2):891-2. PubMed PMID: 11267117.
Höll E, Hering BJ, Bretzel RG, Federlin K. Influence of cryopreservation on islet allograft survival in diabetic rats. Life Support Syst. 1985;3 Suppl 1:675-9. PubMed PMID: 3939684.
Hårdstedt M, Finnegan CP, Kirchhof N, Hyland KA, Wijkstrom M, Murtaugh MP, Hering BJ. Post-transplant upregulation of chemokine messenger Rna in non-human primate recipients of intraportal pig islet xenografts. Xenotransplantation. Jul. 2005;12(4):293-302. PubMed PMID: 15943778.
Hua A, Steinhoff M, Burlak C. Xenotransplantation literature update, Sep.-Oct. 2016. Xenotransplantation. Nov. 2016;23(6):497-498. doi: 10.1111/xen.12281. PubMed PMID: 27897334.
Ihm SH, Matsumoto I, Sawada T, Nakano M, Zhang HJ, Ansite JD, Sutherland DE, Hering BJ. Effect of donor age on function of isolated human islets. Diabetes. May 2006;55(5):1361-8. PubMed PMID: 16644693.
Ihm SH, Matsumoto I, Zhang HJ, Ansite JD, Hering BJ. Effect of short-term culture on functional and stress-related parameters in isolated human islets. Transpl Int. Feb. 2009;22(2):207-16. doi: 10.1111/j.1432-2277.2008.00769.x. PubMed PMID: 18954375.
Jacobson PA, Green KG, Hering BJ. Mycophenolate mofetil in islet cell transplant: variable pharmacokinetics but good correlation between total and unbound concentrations. J Clin Pharmacol. Aug. 2005;45(8):901-9. PubMed PMID: 16027400.
Jaeger C, Brendel MD, Hering BJ, Eckhard M, Bretzel RG. Progressive islet graft failure occurs significantly earlier in autoantibody-positive than in autoantibody-negative Iddm recipients of intrahepatic islet allografts. Diabetes. Nov. 1997;46(11):1907-10. PubMed PMID: 9356046.
Jaeger C, Brendel MD, Hering BJ, Eckhard M, Federlin K, Bretzel RG. IA-2 antibodies are only positive in association with GAD 65 and islet cell antibodies in islet transplanted insulin-dependent diabetes mellitus patients. Transplant Proc. Mar. 1998;30(2):659-60. PubMed PMID: 9532222.
Jaeger C, Hering BJ, Dyrberg T, Federlin K, Bretzel RG. Islet cell antibodies and glutamic acid decarboxylase antibodies in patients with insulin-dependent diabetes mellitus undergoing kidney and islet-after-kidney transplantation. Transplantation. Aug. 15, 1996;62(3):424-6. PubMed PMID: 8779696.
Jaeger C, Hering BJ, Hatziagelaki E, Federlin K, Bretzel RG. Glutamic acid decarboxylase antibodies are more frequent than islet cell antibodies in islet transplanted IDDM patients and persist or occur despite immunosuppression. J Mol Med (Berl). Jan. 1999;77(1):45-8. PubMed PMID: 9930926.
Jahr H, Bretzel RG, Wacker T, Weinand S, Brandhorst H, Brandhorst D, Lau D, Hering BJ, Federlin K. Toxic effects of superoxide, hydrogen peroxide, and nitric oxide on human and pig islets. Transplant Proc. Dec. 1995;27(6):3220-1. PubMed PMID: 8539923.
Jahr H, Hering BJ, Brandhorst H, Brandhorst D, Bretzel RG, Federlin K. Isolated human pancreatic islets in vitro activate human complement. Transplant Proc. Dec. 1995;27(6):3270. PubMed PMID: 8539950.
Jahr H, Pfeiffer G, Hering BJ, Federlin K, Bretzel RG. Endotoxin-mediated activation of cytokine production in human PBMCs by collagenase and Ficoll. J Mol Med (Berl). Jan. 1999;77(1):118-20. PubMed PMID: 9930943.
Kang HK, Wang S, Dangi A, Zhang X, Singh A, Zhang L, Rosati JM, Suarez-Pinzon W, Deng X, Chen X, Thorp EB, Hering BJ, Miller SD, Luo X. Differential role of B cells and IL-17 versus IFN-γ during early and late rejection of pig islet xenografts in mice. Transplantation. Nov. 23, 2016. [Epub ahead of print] PubMed PMID: 27893617.
Kawamoto K, Pahuja A, Hering BJ, Bansal-Pakala P. Transforming growth factor beta 1 (TGF-beta1) and rapamycin synergize to effectively suppress human T cell responses via upregulation of FoxP3+ Tregs. Transpl Immunol. May 2010;23(1-2):28-33. doi: 10.1016/j.trim.2010.03.004. PubMed PMID: 20307666.
Kent SC, Chen Y, Bregoli L, Clemmings SM, Kenyon NS, Ricordi C, Hering BJ, Hafler DA. Expanded T cells from pancreatic lymph nodes of type 1 diabetic subjects recognize an insulin epitope. Nature. May 12, 2005;435(7039):224-8. PubMed PMID: 15889096.
Kirchhof N, Hering BJ, Geiss V, Federlin K, Bretzel RG. Evidence for breed-dependent differences in porcine islets of Langerhans. Transplant Proc. Apr. 1994;26(2):616-7. PubMed PMID: 8171581.
Kirchhof N, Shibata S, Wijkstrom M, Kulick DM, Salerno CT, Clemmings SM, Heremans Y, Galili U, Sutherland DE, Dalmasso AP, Hering BJ. Reversal of diabetes in non-immunosuppressed rhesus macaques by intraportal porcine islet xenografts precedes acute cellular rejection. Xenotransplantation. Sep. 2004;11(5):396-407. PubMed PMID: 15303976.
Kirchner VA, Finger EB, Bellin MD, Dunn TB, Gruessner RW, Hering BJ, Humar A, Kukla AK, Matas AJ, Pruett TL, Sutherland DE, Kandaswamy R. Long-term Outcomes for Living Pancreas Donors in the Modern Era. Transplantation. Jun. 2016;100(6):1322-8. doi: 10.1097/TP.0000000000001250. PubMed PMID: 27203593.
Kissler HJ, Niland JC, Olack B, Ricordi C, Hering BJ, Naji A, Kandeel F, Oberholzer J, Fernandez L, Contreras J, Stiller T, Sowinski J, Kaufman DB. Validation of methodologies for quantifying isolated human islets: an Islet Cell Resources study. Clin Transplant. Mar.-Apr. 2010;24(2):236-42. doi: 10.1111/j.1399-0012.2009.01052.x. PubMed PMID: 19719726; PubMed Central PMCID: PMC3166241.
Kitzmann JP, Karatzas T, Mueller KR, Avgoustiniatos ES, Gruessner AC, Balamurugan AN, Bellin MD, Hering BJ, Papas KK.

(56) References Cited

OTHER PUBLICATIONS

Islet preparation purity is overestimated, and less pure fractions have lower post-culture viability before clinical allotransplantation. Transplant Proc. Jul.-Aug. 2014;46(6):1953-5. doi: 10.1016/j.transproceed.2014.06.011. PubMed PMID: 25131080; PubMed Central PMCID: PMC4148821.
Klöck G, Kowalski MB, Hering BJ, Eiden ME, Weidemann A, Langer S, Zimmermann U, Federlin K, Bretzel RG. Fractions from commercial collagenase preparations: use in enzymic isolation of the islets of Langerhans from porcine pancreas. Cell Transplant. Sep.-Oct. 1996;5(5):543-51. PubMed PMID: 8889213.
Kobayashi SD, Voyich JM, Burlak C, DeLeo FR. Neutrophils in the innate immune response. Arch Immunol Ther Exp (Warsz). Nov.-Dec. 2005;53(6):505-17. Review. PubMed PMID: 16407783.
Kobayashi T, Manivel JC, Carlson AM, Bellin MD, Moran A, Freeman ML, Bielman GJ, Hering BJ, Dunn T, Sutherland DE. Correlation of histopathology, islet yield, and islet graft function after islet autotransplantation in chronic pancreatitis. Pancreas. Mar. 2011;40(2):193-9. PubMed PMID: 21404456.
Kronson JW, Hering BJ, Sutherland DE, Tanioka Y, Leone JP, Kirchhof N, Dalmasso AP. Posttransplant nonfunction of canine islets in PVG rats deficient in complement component C6. Transplantation. Jun. 27, 1998;65(12):1549-54. PubMed PMID: 9665069.
Lakey JR, Warnock GL, Brierton M, Ao Z, Hering BJ, London N, Ricordi C, Corbin F, Rajotte RV. Development of an automated computer-controlled islet isolation system. Transplant Proc. Jun. 1997;29(4):1956. PubMed PMID: 9193472.
Lakey JR, Warnock GL, Brierton M, Ao Z, Hering BJ, London NJ, Ricordi C, Corbin F, Rajotte RV. Development of an automated computer-controlled islet isolation system. Cell Transplant. Jan.-Feb. 1997;6(1):47-57. PubMed PMID: 9040955.
Langer S, Lau D, Eckhardt T, Jahr H, Brandhorst D, Hering BJ, Federlin K, Bretzel RG. Viability and recovery of frozen-thawed human islets and in vivo quality control by xenotransplantation. J Mol Med (Berl). Jan. 1999;77(1):172-4. PubMed PMID: 9930957.
Lau D, Hering BJ, Ei-Ouaghlidi A, Jahr H, Brandhorst H, Brandhorst D, Vietzke R, Federlin K, Bretzel RG. Isokinetic gradient centrifugation prolongs survival of pig islets xenografted into mice. J Mol Med (Berl). Jan. 1999;77(1):175-7. PubMed PMID: 9930958.
Leone JP, Kendall DM, Reinsmoen N, Hering BJ, Sutherland DE. Immediate insulin-independence after retransplantation of islets prepared from an allograft pancreatectomy in a type 1 diabetic patient. Transplant Proc. Mar. 1998;30(2):319. PubMed PMID: 9532059.
Li P, Estrada JL, Burlak C, Tector AJ. Biallelic knockout of the α-1,3 galactosyltransferase gene in porcine liver-derived cells using zinc finger nucleases. J Surg Res. May 1, 2013;181(1):e39-45. doi: 10.1016/j.jss.2012.06.035. PubMed PMID: 22795272.
Linn T, Schmitz P, Kloer HU, Hering BJ, Bretzel RG, Federlin K. Experimental islet isolation from donors with different nutrition regimens. Influence of the fatty acid content and composition of the chow. Horm Metab Res Suppl. 1990;25:17-20. PubMed PMID: 2088962.
Liu B, Hao J, Pan Y, Luo B, Westgard B, Heremans Y, Sutherland DE, Hering BJ, Guo Z. Increasing donor chimerism and inducing tolerance to islet allografts by post-transplant donor lymphocyte infusion. Am J Transplant. May 2006;6(5 Pt 1):933-46. PubMed PMID: 16611329.
Liu X, Brendel MD, Brandhorst D, Brandhorst H, Hering BJ, Federlin K, Bretzel RG. Reversal of diabetes in nude mice by transplantation of cryopreserved fetal porcine proislets. Transplant Proc. Apr. 1994;26(2):707-8. PubMed PMID: 8171619.
Liu X, Brendel MD, Klitscher D, Brandhorst H, Hering BJ, Federlin KF, Bretzel RG. Successful cryopreservation of fetal porcine proislets. Cryobiology. Jun. 1993;30(3):262-71. PubMed PMID: 8370312.

Liu X, Hering BJ, Brendel MD, Bretzel RG. The effect of streptozotocin on the function of fetal porcine and rat pancreatic (pro-)islets. Exp Clin Endocrinol. 1994;102(5):374-9. PubMed PMID: 7867700.
Liu X, Hering BJ, Mellert J, Brandhorst D, Brandhorst H, Federlin K, Bretzel RG, Hopt UT. Prevention of primary nonfunction after porcine islet allotransplantation. Transplant Proc. Jun. 1997;29(4):2071-2. PubMed PMID: 9193532.
Liu X, Hering BJ, Mellert J, Brandhorst D, Brandhorst H, Federlin K, Bretzel RG, Hopt UT. Prolongation of porcine islet allograft survival. Transplant Proc. Feb.-Mar. 1997;29(1-2):768-9. PubMed PMID: 9123518.
Liu X, Mellert J, Hering BJ, Brendel MD, Federlin K, Bretzel RG, Hopt UT. Sensitivity of porcine islet beta cells to the diabetogenic action of streptozotocin. Transplant Proc. Mar. 1998;30(2):574-5. PubMed PMID: 9532181.
Liu XM, Brendel MD, Hering BJ, Bretzel RG, Federlin K. Comparison of the potency of fetal pig pancreatic proislets and fragments to reverse diabetes. Transplant Proc. Jun. 1992;24(3):987. PubMed PMID: 1604700.
Liu XM, Federlin KF, Bretzel RG, Hering BJ, Brendel MD. Persistent reversal of diabetes by transplantation of fetal pig proislets into nude mice. Diabetes. Jul. 1991;40(7):858-66. PubMed PMID: 2060721.
Loganathan G, Dawra RK, Pugazhenthi S, Guo Z, Soltani SM, Wiseman A, Sanders MA, Papas KK, Velayutham K, Saluja AK, Sutherland DE, Hering BJ, Balamurugan AN. Insulin degradation by acinar cell proteases creates a dysfunctional environment for human islets before/after transplantation: benefits of α-1 antitrypsin treatment. Transplantation. Dec. 15, 2011;92(11):1222-30. doi: 10.1097/TP.0b013e318237585c. PubMed PMID: 22089666; PubMed Central PMCID: PMC3587768.
Loganathan G, Graham ML, Radosevich DM, Soltani SM, Tiwari M, Anazawa T, Papas KK, Sutherland DE, Hering BJ, Balamurugan AN. Factors affecting transplant outcomes in diabetic nude mice receiving human, porcine, and nonhuman primate islets: analysis of 335 transplantations. Transplantation. Jun. 27, 2013;95(12):1439-47. doi: 10.1097/TP.0b013e318293b7b8. PubMed PMID: 23677052; PubMed Central PMCID: PMC3721976.
Loganathan G, Graham ML, Spizzo T, Tiwari M, Lockridge AD, Soltani S, Wilhelm JJ, Balamurugan AN, Hering BJ. Pretreatment of donor pigs with a diet rich in soybean oil increases the yield of isolated islets. Transplant Proc. Jul.-Aug. 2014;46(6):1945-9. doi: 10.1016/j.transproceed.2014.05.078. PubMed PMID: 25131078.
Lundberg R, Beilman GJ, Dunn Tb, Pruett TL, Chinnakotla SC, Radosevich DM, Robertson RP, Ptacek P, Balamurugan AN, Wilhelm JJ, Hering BJ, Sutherland DE, Moran A, Bellin MD. Metabolic assessment prior to total pancreatectomy and islet autotransplant: utility, limitations and potential. Am J Transplant. Oct. 2013;13(10):2664-71. doi: 10.1111/ajt.12392. PubMed PMID: 23924045; PubMed Central PMCID: PMC3805695.
Luo B, Wu T, Pan Y, Sozen H, Hao J, Zhang Y, Sutherland DE, Hering BJ, Guo Z. Resistance to the induction of mixed chimerism in spontaneously diabetic NOD mice depends on the CD40/CD154 pathway and donor MHC disparity. Ann N Y Acad Sci. Apr. 2007;1103:94-102. PubMed PMID: 17376827.
Lutz AJ, Li P, Estrada JL, Sidner RA, Chihara RK, Downey SM, Burlak C, Wang ZY, Reyes LM, Ivary B, Yin F, Blankenship RL, Paris LL, Tector AJ. Double knockout pigs deficient in N-glycolylneuraminic acid and galactose α-1,3-galactose reduce the humoral barrier to xenotransplantation. Xenotransplantation. Jan.-Feb. 2013;20(1):27-35. doi: 10.1111/xen.12019. PubMed PMID: 23384142.
Luzi L, Hering BJ, Socci C, Raptis G, Battezzati A, Terruzzi I, Falqui L, Brandhorst H, Brandhorst D, Regalia E, Brambilla E, Secchi A, Perseghin G, Maffi P, Bianchi E, Mazzaferro V, Gennari L, Di Carlo V, Federlin K, Pozza G, Bretzel RG. Metabolic effects of successful intraportal islet transplantation in insulin-dependent diabetes mellitus. J Clin Invest. Jun. 1, 1996;97(11):2611-8. PubMed PMID: 8647955; PubMed Central PMCID: PMC507348.

(56) References Cited

OTHER PUBLICATIONS

Ma L, Tamarina N, Wang Y, Kuznetsov A, Patel N, Kending C, Hering BJ, Philipson LH. Baculovirus-mediated gene transfer into pancreatic islet cells. Diabetes. Dec. 2000;49(12):1986-91. PubMed PMID: 11117998.

Mahler R, Franke FE, Hering BJ, Brandhorst D, Brandhorst H, Brendel MD, Federlin K, Schulz A, Bretzel RG. Evidence for a significant correlation of donor pancreas morphology and the yield of isolated purified human islets. J Mol Med (Berl). Jan. 1999;77(1):87-9. PubMed PMID: 9930935.

Markmann JF, Bartlett St, Johnson P, Korsgren O, Hering BJ, Scharp D, Kay TW, Bromberg J, Odorico JS, Weir GC, Bridges N, Kandaswamy R, Stock P, Friend P, Gotoh M, Cooper DK, Park CG, O'Connell PJ, Stabler C, Matsumoto S, Ludwig B, Choudhary P, Khovatchev B, Rickels MR, Sykes M, Wood K, Kraemer K, Hwa A, Stanley E, Ricordi C, Zimmerman M, Greenstein J, Montanya E, Otonkoski T. Executive Summary of IPITA-TTS Opinion Leaders Report on the Future of β-Cell Replacement. Transplantation. Jul. 2016;100(7):e25-31. doi: 10.1097/TP.0000000000001054. PubMed PMID: 27082827.

Matsumoto I, Sawada T, Nakano M, Sakai T, Liu B, Ansite JD, Zhang HJ, Kandaswamy R, Sutherland DE, Hering BJ. Improvement in islet yield from obese donors for human islet transplants. Transplantation. Sep. 27, 2004;78(6):880-5. PubMed PMID: 15385808.

Meier JJ, Hong-McAtee I, Galasso R, Veldhuis JD, Moran A, Hering BJ, Butler PC. Intrahepatic transplanted islets in humans secrete insulin in a coordinate pulsatile manner directly into the liver. Diabetes. Aug. 2006;55(8):2324-32. PubMed PMID: 16873697.

Mellert J, Hering BJ, Brandhorst H, Klitscher D, Hufnagel B, Bretzel RG, Hopt UT, Federlin K. Experience with islet allografts in immunosuppressed pigs. Horm Metab Res Suppl. 1990;25:187-9. PubMed PMID: 2088965.

Mellert J, Hering BJ, Hopt UT, Bretzel FR, Pfeffer F, Hufnagel B, Klitscher D, Brandhorst H, Federlin K. Effect of local and systemic macrophage blocking on engraftment of allogeneic porcine islets. Transplant Proc. Dec. 1992;24(6):2847. PubMed PMID: 1465968.

Mellert J, Hering BJ, Hopt UT, Bretzel RG, Brandhorst H, Klitscher D, Pfeffer F, Hufnagel B, Federlin K. Allo- and autotransplantation of porcine islets beneath the renal capsule and into the portal vein. Transplant Proc. Feb. 1993;25(1 Pt 2):982-3. PubMed PMID: 8442290.

Mellert J, Hering BJ, Hopt UT, Bretzel RG, Hufnagel B, Pfeffer F, Brandhorst H, Klitscher D, Federlin K. Exchange of pancreata and islets between centers for experimental islet transplantation in the pig. Transplant Proc. Oct. 1991;23(5):2435-6. PubMed PMID: 1926419.

Mellert J, Hering BJ, Hopt UT, Hufnagel B, Bretzel RG, Pfeffer F, Brandhorst H, Klitscher D, Federlin K. Effect of triple drug immunosuppressive therapy in pigs grafted with highly purified islets. Transplant Proc. Jun. 1992;24(3):897-8. PubMed PMID: 1604659.

Mellert J, Hering BJ, Hopt UT, Pfeffer F, Bretzel RG, Brandhorst H, Hessmer I, Klitscher D, Federlin K. Functional outcome after porcine islet autotransplantation beneath the kidney capsule and into the portal vein. Transplant Proc. Apr. 1994;26(2):682-3. PubMed PMID: 8171609.

Mellert J, Hering BJ, Liu X, Brandhorst D, Brandhorst H, Brendel M, Ernst E, Gramberg D, Bretzel RG, Hopt UT. Successful islet auto- and allotransplantation in diabetic pigs. Transplantation. Jul. 27, 1998;66(2):200-4. PubMed PMID: 9701264.

Mellert J, Hering BJ, Liu X, Brandhorst D, Brandhorst H, Federlin K, Bretzel RG, Hopt UT. Intravenous glucose tolerance tests after porcine islet auto- and allotransplantation. Transplant Proc. Jun. 1997;29(4):2091-2. PubMed PMID: 9193541.

Mellert J, Hering BJ, Liu X, Brandhorst D, Brandhorst H, Pfeffer F, Federlin K, Bretzel RG, Hopt UT. Critical islet mass for successful porcine islet autotransplantation. J Mol Med (Berl). Jan. 1999;77(1):126-9. PubMed PMID: 9930946.

Mellert J, Hopt UT, Hering BJ, Bretzel RG, Federlin K. Influence of islet mass and purity on reversibility of diabetes in pancreatectomized pigs. Transplant Proc. Feb. 1991;23(1 Pt 2):1687-9. PubMed PMID: 1989331.

Mellert J, Saalmüller A, Hering BJ, Hopt UT, Bretzel RG, Ernst E, Gramberg D, Hessmer I, Federlin K. Immunologic monitoring after islet allotransplantation in immunosuppressed pigs. Transplant Proc. Dec. 1994;26(6):3423. PubMed PMID: 7998202.

Meyer C, Hering BJ, Grossmann R, Brandhorst H, Brandhorst D, Gerich J, Federlin K, Bretzel RG. Improved glucose counterregulation and autonomic symptoms after intraportal islet transplants alone in patients with long-standing type I diabetes mellitus. Transplantation. Jul. 27, 1998;66(2):233-40. PubMed PMID: 9701271.

Mita A, Ricordi C, Messinger S, Miki A, Misawa R, Barker S, Molano RD, Haertter R, Khan A, Miyagawa S, Pileggi A, Inverardi L, Alejandro R, Hering BJ, Ichii H. Antiproinflammatory effects of iodixanol (OptiPrep)-based density gradient purification on human islet preparations. Cell Transplant. 2010;19(12):1537-46. doi: 10.3727/096368910X516600. PubMed PMID: 20719078; PubMed Central PMCID: PMC3777530.

Nakano M, Matsumoto I, Sawada T, Ansite J, Oberbroeckling J, Zhang HJ, Kirchhof N, Shearer J, Sutherland DE, Hering BJ. Caspase-3 inhibitor prevents apoptosis of human islets immediately after isolation and improves islet graft function. Pancreas. Aug. 2004;29(2):104-9. PubMed PMID: 15257101.

Nath DS, Hering BJ. Islet cells replacement therapy. Clin Lab Med. Sep. 2005;25(3):541-56. Review. PubMed PMID: 16129192.

Pan Y, Luo B, Sozen H, Kalscheuer H, Blazar BR, Sutherland DE, Hering BJ, Guo Z. Blockade of the CD40/CD154 pathway enhances T-cell-depleted allogeneic bone marrow engraftment under nonmyeloablative and irradiation-free conditioning therapy. Transplantation. Jul. 15, 2003;76(1):216-24. PubMed PMID: 12865813.

Papas KK, Avgoustiniatos ES, Tempelman LA, Weir GC, Colton CK, Pisania A, Rappel MJ, Friberg AS, Bauer AC, Hering BJ. High-density culture of human islets on top of silicone rubber membranes. Transplant Proc. Oct. 2005;37(8):3412-4. PubMed PMID: 16298611.

Papas KK, Colton CK, Nelson RA, Rozak PR, Avgoustiniatos ES, Scott WE 3rd, Wildey GM, Pisania A, Weir GC, Hering BJ. Human islet oxygen consumption rate and DNA measurements predict diabetes reversal in nude mice. Am J Transplant. Mar. 2007;7(3):707-13. PubMed PMID: 17229069; PubMed Central PMCID: PMC2857994.

Papas KK, Colton CK, Qipo A, Wu H, Nelson RA, Hering BJ, Weir GC, Koulmanda M. Prediction of marginal mass required for successful islet transplantation. J Invest Surg. Feb. 2010;23(1):28-34. doi: 10.3109/08941930903410825. PubMed PMID: 20233002; PubMed Central PMCID: PMC3786417.

Papas KK, Hering BJ, Guenther L, Rappel MJ, Colton CK, Avgoustiniatos ES. Pancreas oxygenation is limited during preservation with the two-layer method. Transplant Proc. Oct. 2005;37(8):3501-4. Erratum in: Transplant Proc. May 2006;38(4):1205. Gunther, L [corrected to Guenther, L]. PubMed PMID: 16298642.

Paris LL, Chihara RK, Reyes LM, Sidner RA, Estrada JL, Downey SM, Milgrom DP, Tector AJ, Burlak C. ASGR1 expressed by porcine enriched liver sinusoidal endothelial cells mediates human platelet phagocytosis in vitro. Xenotransplantation. Jul.-Aug. 2011;18(4):245-51. doi: 10.1111/j.1399-3089.2011.00639.x. Erratum in: Xenotransplantation. Jul.-Aug. 2012;19(4):269. Milgrom, Daniel A [corrected to Milgrom, Daniel P]. PubMed PMID: 21848542.

Paris LL, Chihara RK, Sidner RA, Tector AJ, Burlak C. Differences in human and porcine platelet oligosaccharides may influence phagocytosis by liver sinusoidal cells in vitro. Xenotransplantation. Jan.-Feb. 2012;19(1):31-9. doi: 10.1111/j.1399-3089.2011.00685.x. PubMed PMID: 22360751.

Pierson RN 3rd, Dorling A, Ayares D, Rees MA, Seebach JD, Fishman JA, Hering BJ, Cooper DK. Current status of xenotransplantation and prospects for clinical application. Xenotransplantation. Sep.-Oct. 2009;16(5):263-80. doi: 10.1111/j.1399-3089.2009.00534.x. Review. PubMed PMID: 19796067; PubMed Central PMCID: PMC2866107.

(56) References Cited

OTHER PUBLICATIONS

Posselt AM, Bellin MD, Tavakol M, Szot GL, Frassetto LA, Masharani U, Kerlan RK, Fong L, Vincenti FG, Hering BJ, Bluestone JA, Stock PG. Islet transplantation in type 1 diabetics using an immunosuppressive protocol based on the anti-LFA-1 antibody efalizumab. Am J Transplant. Aug. 2010;10(8):1870-80. doi: 10.1111/j.1600-6143.2010.03073.x. PubMed PMID: 20659093; PubMed Central PMCID: PMC2911648.

Prabhakaran S, Hering BJ. What strain of pig should be used? Xenotransplantation. Mar.-Apr. 2008;15(2):83-6. doi: 10.1111/j.1399-3089.2008.00456.x. Review. PubMed PMID: 18447873.

Rabkin JM, Olyaei AJ, Orloff SL, Geisler SM, Wahoff DC, Hering BJ, Sutherland DE. Distant processing of pancreas islets for autotransplantation following total pancreatectomy. Am J Surg. May 1999;177(5):423-7. PubMed PMID: 10365884.

Radosevich DM, Jevne R, Bellin M, Kandaswamy R, Sutherland DE, Hering BJ. Comprehensive health assessment and five-yr follow-up of allogeneic islet transplant recipients. Clin Transplant. Nov.-Dec. 2013;27(6):E715-24. doi: 10.1111/ctr.12265. PubMed PMID: 24304379; PubMed Central PMCID: PMC4132880.

Rayat GR, Gazda LS, Hawthorne WJ, Hering BJ, Hosking P, Matsumoto S, Rajotte RV. First update of the International Xenotransplantation Association consensus statement on conditions for undertaking clinical trials of porcine islet products in type 1 diabetes—Chapter 3: Porcine islet product manufacturing and release testing criteria. Xenotransplantation. Jan.-Feb. 2016;23(1):38-45. doi: 10.1111/xen.12225. PubMed PMID: 26923763.

Rayat GR, Rajotte RV, Hering BJ, Binette TM, Korbutt GS. In vitro and in vivo expression of Galalpha-(1,3)Gal on porcine islet cells is age dependent. J Endocrinol. Apr. 2003;177(1):127-35. PubMed PMID: 12697044.

Ricordi C, Goldstein JS, Balamurugan AN, Szot GL, Kin T, Liu C, Czarniecki CW, Barbaro B, Bridges ND, Cano J, Clarke WR, Eggerman TL, Hunsicker LG, Kaufman DB, Khan A, Lafontant DE, Linetsky E, Luo X, Markmann JF, Naji A, Korsgren O, Oberholzer J, Turgeon NA, Brandhorst D, Friberg AS, Lei J, Wang LJ, Wilhelm JJ, Willits J, Zhang X, Hering BJ, Posselt AM, Stock PG, Shapiro AM. National Institutes of Health-Sponsored Clinical Islet Transplantation Consortium Phase 3 Trial: Manufacture of a Complex Cellular Product at Eight Processing Facilities. Diabetes. Nov. 2016;65(11):3418-3428. PubMed PMID: 27465220; PubMed Central PMCID: PMC5079635.

Ricordi C, Gray DW, Hering BJ, Kaufman DB, Warnock GL, Kneteman NM, Lake SP, London NJ, Socci C, Alejandro R, et al. Islet isolation assessment in man and large animals. Acta Diabetol Lat. Jul.-Sep. 1990;27(3):185-95. PubMed PMID: 2075782.

Ricordi C, Hering BJ, Shapiro AM; Clinical Islet Transplantation Consortium. Beta-cell transplantation for diabetes therapy. Lancet. Jul. 5, 2008;372(9632):27-8; author reply 29-30. doi: 10.1016/S0140-6736(08)60984-8. PubMed PMID: 18603151.

Ricordi C, Lakey JR, Hering BJ. Challenges toward standardization of islet isolation technology. Transplant Proc. Feb.-Mar. 2001;33(1-2):1709. PubMed PMID: 11267479.

Rizzari MD, Suszynski TM, Kidder LS, Stein SA, O'Brien TD, Sajja VS, Scott WE 3rd, Kirchner VA, Weegman BP, Avgoustiniatos ES, Todd PW, Kennedy DJ, Hammer BE, Sutherland DE, Hering BJ, Papas KK. Surgical protocol involving the infusion of paramagnetic microparticles for preferential incorporation within porcine islets. Transplant Proc. Dec. 2010;42(10):4209-12. doi: 10.1016/j.transproceed.2010.09.138. PubMed PMID: 21168666; PubMed Central PMCID: PMC3035915.

Robertson SJ, Messer RJ, Carmody AB, Mittler RS, Burlak C, Hasenkrug KJ. CD137 costimulation of CD8+ T cells confers resistance to suppression by virus-induced regulatory T cells. J Immunol. Apr. 15, 2008;180(8):5267-74. Erratum in: J Immunol. Jul. 15, 2008;181(2):1582. PubMed PMID: 18390707; PubMed Central PMCID: PMC2768524.

Rozak PR, Weegman BP, Avgoustiniatos ES, Wilson JR, Welch DP, Hering BJ, Papas KK. Devices and methods for maintenance of temperature and pressure during islet shipment. Transplant Proc. Mar. 2008;40(2):407-10. doi: 10.1016/j.transproceed.2008.01.060. PubMed PMID: 18374083; PubMed Central PMCID: PMC2799926.

Sageshima J, Kirchhof N, Shibata S, Hiraoka K, Sutherland DE, Hering BJ. Small bowel subserosal space as a site for islet transplantation and local drug delivery. Transplant Proc. Feb.-Mar. 2001;33(1-2):1710. PubMed PMID: 11267480.

Sawada T, Matsumoto I, Nakano M, Kirchhof N, Sutherland DE, Hering BJ. Improved islet yield and function with ductal injection of University of Wisconsin solution before pancreas preservation. Transplantation. Jun. 27, 2003;75(12):1965-9. PubMed PMID: 12829895.

Schrezenmeir J, Hering BJ, Gerö L, Wiegand-Dressler J, Solhdju M, Velten F, Kirchgessner J, Laue C, Beyer J, Bretzel R, et al. Long-term function of porcine islets and single cells embedded in barium-alginate matrix. Horm Metab Res. Apr. 1993;25(4):204-9. PubMed PMID: 8514239.

Scott WE 3rd, Matsumoto S, Tanaka T, Avgoustiniatos ES, Graham ML, Williams PC, Tempelman LA, Sutherland DE, Hering BJ, Hammer BE, Papas KK. Real-time noninvasive assessment of pancreatic ATP levels during cold preservation. Transplant Proc. Mar. 2008;40(2):403-6. doi: 10.1016/j.transproceed.2008.01.042. PubMed PMID: 18374082; PubMed Central PMCID: PMC2610284.

Scott WE 3rd, O'Brien TD, Ferrer-Fabrega J, Avgoustiniatos ES, Weegman BP, Anazawa T, Matsumoto S, Kirchner VA, Rizzari MD, Murtaugh MP, Suszynski TM, Aasheim T, Kidder LS, Hammer BE, Stone SG, Tempelman LA, Sutherland DE, Hering BJ, Papas KK. Persufflation improves pancreas preservation when compared with the two-layer method. Transplant Proc. Jul.-Aug. 2010;42(6):2016-9. doi: 10.1016/j.transproceed.2010.05.092. PubMed PMID: 20692396; PubMed Central PMCID: PMC2956134.

Scott WE 3rd, Weegman BP, Balamurugan AN, Ferrer-Fabrega J, Anazawa T, Karatzas T, Jie T, Hammer BE, Matsumoto S, Avgoustiniatos ES, Maynard KS, Sutherland DE, Hering BJ, Papas KK. Magnetic resonance imaging: a tool to monitor and optimize enzyme distribution during porcine pancreas distention for islet isolation. Xenotransplantation. Sep.-Oct. 2014;21(5):473-9. doi: 10.1111/xen.12108. PubMed PMID: 24986758; PubMed Central PMCID: PMC4174958.

Scott WE 3rd, Weegman BP, Ferrer-Fabrega J, Stein SA, Anazawa T, Kirchner VA, Rizzari MD, Stone J, Matsumoto S, Hammer BE, Balamurugan AN, Kidder LS, Suszynski TM, Avgoustiniatos ES, Stone SG, Tempelman LA, Sutherland DE, Hering BJ, Papas KK. Pancreas oxygen persufflation increases ATP levels as shown by nuclear magnetic resonance. Transplant Proc. Jul.-Aug. 2010;42(6):2011-5. doi: 10.1016/j.transproceed.2010.05.091. PubMed PMID: 20692395; PubMed Central PMCID: PMC2947552.

Shapiro AM, Ricordi C, Hering BJ, Auchincloss H, Lindblad R, Robertson RP, Secchi A, Brendel MD, Berney T, Brennan DC, Cagliero E, Alejandro R, Ryan EA, DiMercurio B, Morel P, Polonsky KS, Reems JA, Bretzel RG, Bertuzzi F, Froud T, Kandaswamy R, Sutherland DE, Eisenbarth G, Segal M, Preiksaitis J, Korbutt GS, Barton FB, Viviano L, Seyfert-Margolis V, Bluestone J, Lakey JR. International trial of the Edmonton protocol for islet transplantation. N Engl J Med. Sep. 28, 2006;355(13):1318-30. PubMed PMID: 17005949.

Shen W, Taylor B, Jin Q, Nguyen-Tran V, Meeusen S, Zhang YQ, Kamireddy A, Swafford A, Powers AF, Walker J, Lamb J, Bursalaya B, DiDonato M, Harb G, Qiu M, Filippi CM, Deaton L, Turk CN, Suarez-Pinzon WL, Liu Y, Hao X, Mo T, Yan S, Li J, Herman AE, Hering BJ, Wu T, Martin Seidel H, McNamara P, Glynne R, Laffitte B. Inhibition of DYRK1A and GSK3B induces human β-cell proliferation. Nat Commun. Oct. 26, 2015;6:8372. doi: 10.1038/ncomms9372. PubMed PMID: 26496802; PubMed Central PMCID: PMC4639830.

Shenkman RM, Chalmers JJ, Hering BJ, Kirchhof N, Papas KK. Quadrupole magnetic sorting of porcine islets of Langerhans. Tissue Eng Part C Methods. Jun. 2009;15(2):147-56. doi: 10.1089/ten.tec.

(56) References Cited

OTHER PUBLICATIONS 2008.0343. Erratum in: Tissue Eng Part C Methods. Sep. 2009;15(3):529. PubMed PMID: 19505179; PubMed Central PMCID: PMC2752691.
Shibata S, Kirchhof N, Matsumoto S, Sageshima J, Hiraoka K, Ansite J, Wistrom M, Sutherland DE, Hering BJ. High-dose streptozotocin for diabetes induction in adult rhesus monkeys. Transplant Proc. Jun. 2002;34(4):1341-4. PubMed PMID: 12072355.
Shibata S, Matsumoto S, Sageshima J, Hiraoka K, Sutherland DE, Kirchhof N, Guo Z, Koyama K, Gilmore TR, Dunning M, Ansite JD, Shearer JD, Clemmings S, Hedlund BE, Sehgal SN, Hering BJ. Temporary treatment with sirolimus and low-trough cyclosporine prevents acute islet allograft rejection, and combination with starch-conjugated deferoxamine promotes islet engraftment in the preclinical pig model. Transplant Proc. Feb.-Mar. 2001;33(1-2):509. PubMed PMID: 11266930.
Sindberg GM, Lindborg BA, Wang Q, Clarkson C, Graham M, Donahue R, Hering BJ, Verfaillie CM, Bansal-Pakala P, O'Brien TD. Comparisons of phenotype and immunomodulatory capacity among rhesus bone-marrow-derived mesenchymal stem/stromal cells, multipotent adult progenitor cells, and dermal fibroblasts. J Med Primatol. Aug. 2014;43(4):231-41. doi: 10.1111/jmp.12122. PubMed PMID: 24825538; PubMed Central PMCID: PMC4699285.
Soltani SM, O'Brien TD, Loganathan G, Bellin MD, Anazawa T, Tiwari M, Papas KK, Vickers SM, Kumaravel V, Hering BJ, Sutherland DE, Balamurugan AN. Severely fibrotic pancreases from young patients with chronic pancreatitis: evidence for a ductal origin of islet neogenesis. Acta Diabetol. Oct. 2013;50(5):807-14. doi: 10.1007/s00592-011-0306-9. PubMed PMID: 21773756; PubMed Central PMCID: PMC4124082.
Steinhoff M, Naqvi R, Burlak C. Xenotransplantation literature update, Nov./Dec. 2016. Xenotransplantation. Jan. 2017;24(1). doi: 10.1111/xen.12290. PubMed PMID: 28160329.
Stevens RB, Sutherland DE, Ansite JD, Saxena M, Rossini TJ, Levay-Young BK, Hering BJ, Mills CD. Insulin down-regulates the inducible nitric oxide synthase pathway: nitric oxide as cause and effect of diabetes? J Immunol. Dec. 1, 1997;159(11):5329-35. PubMed PMID: 9548472.
Suszynski TM, Wildey GM, Falde EJ, Cline GW, Maynard KS, Ko N, Sotiris J, Naji A, Hering BJ, Papas KK. The ATP/DNA ratio is a better indicator of islet cell viability than the ADP/ATP ratio. Transplant Proc. Mar. 2008;40(2):346-50. doi: 10.1016/j.transproceed.2008.01.061. PubMed PMID: 18374063; PubMed Central PMCID: PMC2804259.
Suszynski TM, Wilhelm JJ, Radosevich DM, Balamurugan AN, Sutherland DE, Beilman GJ, Dunn TB, Chinnakotla S, Pruett TL, Vickers SM, Hering BJ, Papas KK, Bellin MD. Islet size index as a predictor of outcomes in clinical islet autotransplantation. Transplantation. Jun. 27, 2014;97(12):1286-91. doi: 10.1097/01.TP.0000441873.35383.1e. PubMed PMID: 24621532; PubMed Central PMCID: PMC4682552.
Sutherland DE, Gores PF, Hering BJ, Wahoff D, McKeehen DA, Gruessner RW. Islet transplantation: an update. Diabetes Metab Rev. Jul. 1996;12(2):137-50. Review. PubMed PMID: 8877283.
Sutherland DE, Gruessner A, Hering BJ. Beta-cell replacement therapy (pancreas and islet transplantation) for treatment of diabetes mellitus: an integrated approach. Endocrinol Metab Clin North Am. Mar. 2004;33(1):135-48, x. Review. PubMed PMID: 15053899.
Sutherland DE, Gruessner AC, Carlson AM, Blondet JJ, Balamurugan AN, Reigstad KF, Beilman GJ, Bellin MD, Hering BJ. Islet autotransplant outcomes after total pancreatectomy: a contrast to islet allograft outcomes. Transplantation. Dec. 27, 2008;86(12):1799-802. doi: 10.1097/TP.0b013e31819143ec. PubMed PMID: 19104425.
Tanioka Y, Hering BJ, Sutherland DE, Kronson JW, Kuroda Y, Gilmore TR, Aasheim TC, Rusten MC, Leone JP. Effect of pancreatic warm ischemia on islet yield and viability in dogs. Transplantation. Dec. 27, 1997;64(12):1637-41. PubMed PMID: 9422394.

Tian B, Hao J, Zhang Y, Tian L, Yi H, O'Brien TD, Sutherland DE, Hering BJ, Guo Z. Upregulating CD4+CD25+FOXP3+ regulatory T cells in pancreatic lymph nodes in diabetic NOD mice by adjuvant immunotherapy. Transplantation. Jan. 27, 2009;87(2):198-206. doi: 10.1097/TP.0b013e3181933261. PubMed PMID: 19155973.
Van der Laan LJ, Lockey C, Griffeth BC, Frasier FS, Wilson CA, Onions DE, Hering BJ, Long Z, Otto E, Torbett BE, Salomon DR. Infection by porcine endogenous retrovirus after islet xenotransplantation in SCID mice. Nature. Sep. 7, 2000;407(6800):90-4. PubMed PMID: 10993079.
Wacker T, Jahr H, Weinand S, Brandhorst H, Brandhorst D, Lau D, Hering BJ, Federlin K, Bretzel RG. Different toxic effects of hydrogen peroxide, nitric oxide, and superoxide on human, pig, and rat islets of Langerhans. Exp Clin Endocrinol Diabetes. 1995;103 Suppl 2:133-35. PubMed PMID: 8839270.
Waghmare SK, Estrada J, Reyes L, Li P, Ivary B, Sidner RA, Burlak C, Tector AJ. Gene targeting and cloning in pigs using fetal liver derived cells. J Surg Res. Dec. 2011;171(2):e223-9. doi: 10.1016/j.jss.2011.07.051. PubMed PMID: 21962810.
Waldman JP, Vogel T, Burlak C, Coussios C, Dominguez J, Friend P, Rees MA. Blocking porcine sialoadhesin improves extracorporeal porcine liver xenoperfusion with human blood. Xenotransplantation. Jul.-Aug. 2013;20(4):239-51. doi: 10.1111/xen.12043. PubMed PMID: 23822217; PubMed Central PMCID: PMC4228799.
Wang LJ, Kin T, O'Gorman D, Shapiro AM, Naziruddin B, Takita M, Levy MF, Posselt AM, Szot GL, Savari O, Barbaro B, McGarrigle J, Yeh CC, Oberholzer J, Lei J, Chen T, Lian M, Markmann JF, Alvarez A, Linetsky E, Ricordi C, Balamurugan AN, Loganathan G, Wilhelm JJ, Hering BJ, Bottino R, Trucco M, Liu C, Min Z, Li Y, Naji A, Fernandez LA, Ziemelis M, Danobeitia JS, Millis JM, Witkowski P. A Multicenter Study: North American Islet Donor Score in Donor Pancreas Selection for Human Islet Isolation for Transplantation. Cell Transplant. 2016;25(8):1515-23. doi: 10.3727/096368916X691141. PubMed PMID: 26922947; PubMed Central PMCID: PMC5167495.
Wang ZY, Burlak C, Estrada JL, Li P, Tector MF, Tector AJ. Erythrocytes from GGTA1/CMAH knockout pigs: implications for xenotransfusion and testing in non-human primates. Xenotransplantation. Jul.-Aug. 2014;21(4):376-84. doi: 10.1111/xen.12106. PubMed PMID: 24986655; PubMed Central PMCID: PMC4366650.
Wang ZY, Paris LL, Chihara RK, Tector AJ, Burlak C. Immortalized porcine liver sinusoidal endothelial cells: an in vitro model of xenotransplantation-induced thrombocytopenia. Xenotransplantation. Jul.-Aug. 2012;19(4):249-55. doi: 10.1111/j.1399-3089.2012.00715.x. PubMed PMID: 22909138.
Weegman BP, Kumar Sajja VS, Suszynski TM, Rizzari MD, Scott Iii WE, Kitzmann JP, Mueller KR, Hanley TR, Kennedy DJ, Todd PW, Balamurugan AN, Hering BJ, Papas KK. Continuous Quadrupole Magnetic Separation of Islets during Digestion Improves Purified Porcine Islet Viability. J Diabetes Res. 2016;2016:6162970. PubMed PMID: 27843954; PubMed Central PMCID: PMC5097811.
Weegman BP, Suszynski TM, Scott WE 3rd, Ferrer Fábrega J, Avgoustiniatos ES, Anazawa T, O'Brien TD, Rizzari MD, Karatzas T, Jie T, Sutherland DE, Hering BJ, Papas KK. Temperature profiles of different cooling methods in porcine pancreas procurement. Xenotransplantation. Nov.-Dec. 2014;21(6):574-81. doi: 10.1111/xen.12114. PubMed PMID: 25040217; PubMed Central PMCID: PMC4262706.
Weinand S, Jahr H, Hering BJ, Federlin K, Bretzel RG. Oxygen radical production in human mononuclear blood cells is not suppressed by drugs used in clinical islet transplantation. J Mol Med (Berl). Jan. 1999;77(1):121-2. PubMed PMID: 9930944.
White SA, Nicholson ML, Hering BJ. Can islet cell transplantation treat diabetes? BMJ. Sep. 16, 2000;321(7262):651-2. PubMed PMID: 10987752; PubMed Central PMCID: PMC1118541.
Wijkstrom M, Kenyon NS, Kirchhof N, Kenyon NM, Mullon C, Lake P, Cottens S, Ricordi C, Hering BJ. Islet allograft survival in nonhuman primates immunosuppressed with basiliximab, RAD, and FTY720. Transplantation. Mar. 27, 2004;77(6):827-35. PubMed PMID: 15077021.

(56) References Cited

OTHER PUBLICATIONS

Wijkstrom M, Kirchhof N, Graham M, Ingulli E, Colvin RB, Christians U, Hering BJ, Schuurman HJ. Cyclosporine toxicity in immunosuppressed streptozotocin-diabetic nonhuman primates. Toxicology. Feb. 1, 2005;207(1):117-27. PubMed PMID: 15590127.

Wilhelm JJ, Bellin MD, Dunn TB, Balamurugan AN, Pruett TL, Radosevich DM, Chinnakotla S, Schwarzenberg SJ, Freeman ML, Hering BJ, Sutherland DE, Beilman GJ. Proposed thresholds for pancreatic tissue volume for safe intraportal islet autotransplantation after total pancreatectomy. Am J Transplant. Dec. 2013;13(12):3183-91. doi: 10.1111/ajt.12482. PubMed PMID: 24148548; PubMed Central PMCID: PMC4087156.

Winoto-Morbach S, Ulrichs K, Hering BJ, Leyhausen G, Müller-Ruchholz W. Lectins for electromagnetic purification of islets from humans and large mammals. Horm Metab Res Suppl. 1990;25:51-4. PubMed PMID: 2088985.

Wu T, Sozen H, Luo B, Heuss N, Kalscheuer H, Lan P, Sutherland DE, Hering BJ, Guo Z. Rapamycin and T cell costimulatory blockade as post-transplant treatment promote fully MHC-mismatched allogeneic bone marrow engraftment under irradiation-free conditioning therapy. Bone Marrow Transplant. Jun. 2002;29(12):949-56. PubMed PMID: 12098061.

Co-pending U.S. Appl. No. 15/100,105, filed May 27, 2016.

Co-pending U.S. Appl. No. 15/302,655, filed Oct. 7, 2016.

Wiedenheft, et al. RNA-guided genetic silencing systems in bacteria and archaea. Nature. Feb. 15, 2012;482(7385):331-8. doi: 10.1038/nature10886.

\* cited by examiner

NL1_First target site within NLRC5 gene

NLR amp 2 set amplicon size: 217 bp

Strong single band observed at the amplicon size. Product was sequence verified and was shown to include NL1_First target cut-site as desired for screening.

FIG. 18C

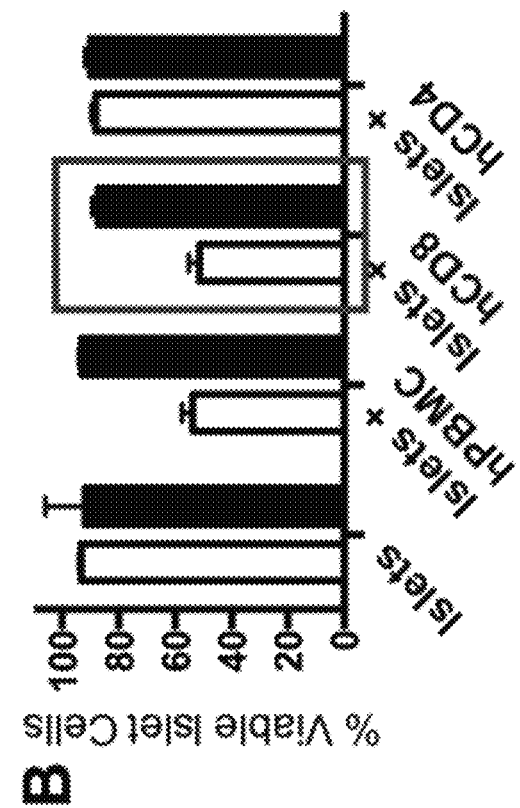
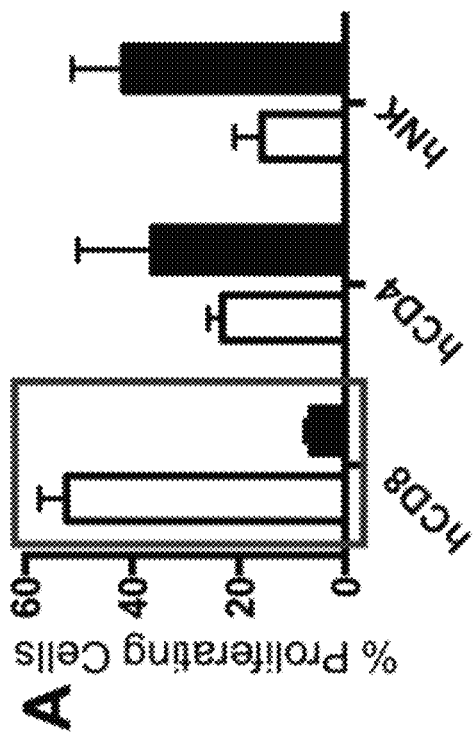
FIG. 19B
FIG. 19A

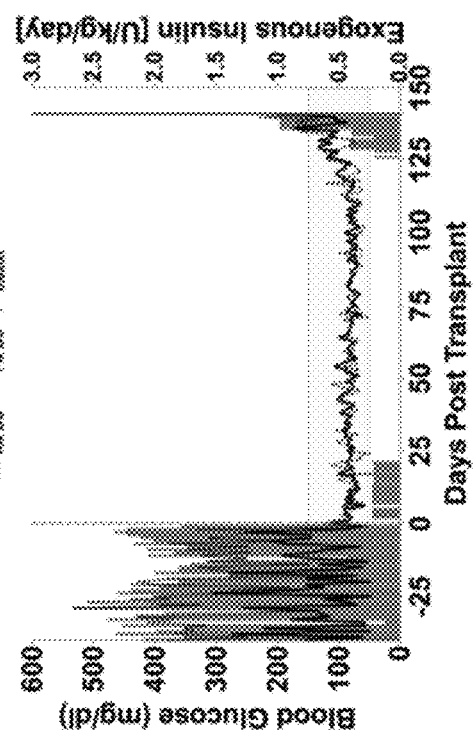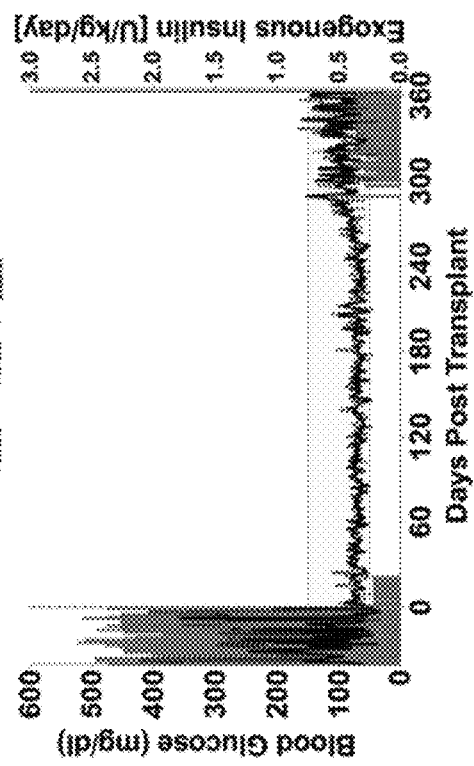
FIG. 22A
FIG. 22B

GENETICALLY MODIFIED CELLS, TISSUES, AND ORGANS FOR TREATING DISEASE

CROSS-REFERENCE

This application claims the benefit of U.S. Provisional Patent Application No. 62/090,037, filed on Dec. 10, 2014, and U.S. Provisional Patent Application No. 62/253,493, filed on Nov. 10, 2015, which are both herein incorporated by reference in their entirety.

SEQUENCE LISTING

The instant application contains a Sequence Listing which has been submitted electronically in ASCII format and is hereby incorporated by reference in its entirety. Said ASCII copy, created on Feb. 10, 2017, is named 47190-701.201_SL.txt and is 713,905 bytes in size.

BACKGROUND OF THE DISCLOSURE

There is a shortage of organs, tissues or cells available for transplantation in recipients such as humans. Xenotransplantation or allotransplantation of organs, tissues, or cells into humans has the potential to fulfill this need and help hundreds of thousands of people every year. Non-human animals can be chosen as organ donors based on their anatomical and physiological similarities to humans. Additionally, xenotransplantation has implications not only in humans, but also in veterinary applications.

However, unmodified wild-type non-human animal tissues can be rejected by recipients, such as humans, by the immune system. Rejection is believed to be caused at least in part by antibodies binding to the tissues and cell-mediated immunity leading to graft loss. For example, pig grafts can be rejected by cellular mechanisms mediated by adaptive immune cells.

INCORPORATION BY REFERENCE

All publications, patents, and patent applications herein are incorporated by reference to the same extent as if each individual publication, patent, or patent application was specifically and individually indicated to be incorporated by reference. In the event of a conflict between a term herein and a term in an incorporated reference, the term herein controls.

SUMMARY

Disclosed herein are compositions and methods for treating or preventing diseases. Also disclosed are genetically modified cells and methods of making the genetically modified cells for treating or preventing disease. Further disclosed are genetically modified non-human animals and methods of making genetically modified non-human animals that can be used in treating or preventing disease, e.g., by later extracting cells, tissues, or organs from these genetically modified non-human animals and transplanting them into a subject. Also disclosed herein are methods for treating or preventing diseases using the genetically modified cells, tissues, and organs. Additionally disclosed are methods for treating or preventing diseases using cells, tissues, and/or organs from genetically modified non-human animals.

In one aspect, disclosed herein is a genetically modified animal with reduced protein expression of one or more first genes, where the genetically modified animal is a member of the Laurasiatheria superorder or is a non-human primate, where the one or more first genes comprise a) a component of a major histocompatibility complex (MHC) I-specific enhanceosome, b) a transporter of an MHC I-binding peptide, and/or c) complement component 3 (C3), where the reduced protein expression is in comparison to a non-genetically modified counterpart animal. In some cases, the member of the Laurasiatheria super order is an ungulate. In some cases, the ungulate is a pig. In some cases, the protein expression of the one or more first genes is absent in the genetically modified animal. In some cases, the reduction of protein expression inactivates a function of the one or more first genes. In some cases, the genetically modified animal has reduced protein expression of two or more the first genes. In some cases, the genetically modified animal comprises reduced expression of a component of a MHC I-specific enhanceosome, where the component of a MHC I-specific enhanceosome is NOD-like receptor family CARD domain containing 5 (NLRC5). In some cases, the genetically modified animal comprises reduced expression of a transporter of a MHC I-binding peptide, where the transporter is transporter associated with antigen processing 1 (TAP1). In some cases, the genetically modified animal comprises reduced expression of comprising C3. In some cases, the genetically modified animal has reduced protein expression of three or more the first genes.

In some cases, the genetically modified animal further comprises reduced protein expression of one or more second genes, where the one or more second genes comprise: a) a natural killer (NK) group 2D ligand, b) an endogenous gene not expressed in a human, c) a CXC chemokine receptor (CXCR) 3 ligand, and/or d) MHC II transactivator (CIITA), where the reduced protein expression is in comparison to a non-genetically modified counterpart animal. In some cases, the protein expression of the one or more second genes is absent in the genetically modified animal. In some cases, the reduction of protein expression inactivates a function of the one or more second genes. In some cases, the genetically modified animal comprises reduced protein expression of a NK group 2D ligand, where the NK group 2D ligand is MHC class I polypeptide-related sequence A (MICA) or MHC class I polypeptide-related sequence B (MICB). In some cases, the genetically modified animal comprises reduced protein expression of an endogenous gene not expressed in a human, where the endogenous gene not expressed in a human is glycoprotein galactosyltransferase alpha 1,3 (GGTA1), putative cytidine monophosphate-N-acetylneuraminic acid hydroxylase-like protein (CMAH), or β1,4 N-acetylgalactosaminyltransferase (B4GALNT2). In some cases, the genetically modified animal comprises reduced protein expression of a CXCR3 ligand, where the CXCR3 ligand is C-X-C motif chemokine 10 (CXCL10).

In some cases, the genetically modified animal further comprises one or more exogenous polynucleotides encoding one or more proteins or functional fragments thereof, where the one or more proteins comprise: a) an MHC I formation suppressor, b) a regulator of complement activation, c) an inhibitory ligand for NK cells, d) a B7 family member, e) CD47, f) a serine protease inhibitor, and/or g) galectin. In some cases, the one or more proteins are human proteins. In some cases, the genetically modified animal comprises one or more exogenous polynucleotides encoding an MHC I formation suppressor, where the MHC I formation suppressor is infected cell protein 47 (ICP47). In some cases, the genetically modified animal comprises one or more exogenous polynucleotides encoding a regulator of complement activation, where the regulator of complement activation is cluster of differentiation 46 (CD46), cluster of differentiation 55 (CD55), or cluster of differentiation 59 (CD59). In some cases, the genetically modified animal comprises one or more exogenous polynucleotides encoding an inhibitory ligand for NK cells, where the inhibitory ligands for NK cells is leukocyte antigen E (HLA-E), human leukocyte antigen G (HLA-G), or β-2-microglobulin (B2M). In some cases, the genetically modified animal comprises one or more exogenous polynucleotides encoding HLA-G, where the HLA-G is HLA-G1, HLA-G2, HLA-G3, HLA-G4, HLA-G5, HLA-G6, or HLA-G7. In some cases, the HLA-G is HLA-G1. In some cases, the genetically modified animal comprises one or more exogenous polynucleotides encoding a B7 family member, where the B7 family member is a programmed death-ligand. In some cases, the programmed death-ligand is programmed death-ligand 1 (PD-L1) or programmed death-ligand 2 (PD-L2). In some cases, the one or more exogenous polynucleotides encode both PD-L1 and PD-L2. In some cases, the genetically modified animal comprises one or more exogenous polynucleotides encoding a serine protease inhibitor, where the serine protease inhibitor is serine protease inhibitor 9 (Spi9). In some cases, the genetically modified animal comprises one or more exogenous polynucleotides encoding a galectin, where the galectin is galectin-9.

In some cases, the genetically modified animal comprises reduced protein expression of NLRC5 or TAP1, C3, reduced protein expression of CXCL10, GGTA1, CMAH, and/or B4GALNT2; and/or one or more exogenous polynucleotides encoding HLA-G1, HLA-E, or a functional fragment thereof, PD-L1 or a functional fragment thereof, PD-L2 or a functional fragment thereof, and/or CD47 or a functional fragment thereof. In some cases, the one or more exogenous polynucleotides are inserted adjacent to a ubiquitous promoter. In some cases, the ubiquitous promoter is a Rosa26 promoter. In some cases, the one or more exogenous polynucleotides are inserted adjacent to a promoter of a targeted gene or within the targeted gene. In some cases, the targeted gene is one of the first genes or one of the second genes. In some cases, the protein expression of the one or more first genes is reduced using a CRISPR/cas system. In some cases, the protein expression of the one or more second genes is reduced using a CRISPR/cas system.

In another aspect, disclosed herein is a genetically modified animal that is a member of the Laurasiatheria superorder or is a non-human primate comprising: an exogenous polynucleotide encoding an inhibitory ligand for an NK cell or a functional fragment thereof, and reduced protein expression of an endogenous gene, where the reduced protein expression is in comparison to a non-genetically modified counterpart animal. In some cases, the inhibitory ligand for an NK cell is HLA-E or HLA-G. In some cases, the inhibitory ligand for an NK cell is HLA-G, where the HLA-G is HLA-G1, HLA-G2, HLA-G3, HLA-G4, HLA-G5, HLA-G6, or HLA-G7. In some cases, the HLA-G is HLA-G. In some cases, the endogenous gene is a gene not expressed in a human. In some cases, the endogenous gene is GGTA1, CMAH, and/or B4GALNT2.

In some cases, the genetically modified animal further comprises exogenous polynucleotides encoding: a) PD-L1 or a functional fragment thereof, b) PD-L2 or a functional fragment thereof, and/or c) CD47 or a functional fragment thereof. In some cases, the exogenous polynucleotides are inserted adjacent to a ubiquitous promoter. In some cases, the ubiquitous promoter is a Rosa26 promoter. In some cases, the exogenous polynucleotides are inserted adjacent to a promoter of the endogenous gene, or within the endogenous gene. In some cases, the protein expression of the endogenous genes is reduced using a CRISPR/cas system.

Further disclosed herein is a population of genetically modified animals comprising two or more animals disclosed in the application. In some cases, at least two or more animals have identical phenotypes. In some cases, at least two or more animals have identical genotypes.

In another aspect, disclosed herein is a genetically modified cell from a member of the Laurasiatheria superorder or a non-human primate, comprising reduced protein expression of one or more first genes, where the one or more first genes comprise: a) a component of a MHC I-specific enhanceosome, b) a transporter of a MHC I-binding peptide, and/or c) C3, where the reduced protein expression is in comparison to a non-genetically modified counterpart cell. In some cases, the genetically modified cell comprises reduced protein expression of a component of a MHC I-specific enhanceosome, where the component of MHC I-specific enhanceosome is NLRC5. In some cases, the genetically modified cell comprises reduced protein expression of a transporter of a MHC I-binding peptide, where the transporter of a MHC I-binding peptide is TAP1. In some cases, the genetically modified cell comprises reduced protein expression of C3.

In some cases, the genetically modified cell further comprises reduced protein expression of one or more second genes, where the one or more second genes comprise: a) an NK group 2D ligands, b) an endogenous gene not expressed in a human, c) a CXCR3 ligand, and/or d) CIITA, where the reduced protein expression is in comparison to a non-genetically modified counterpart cell. In some cases, the genetically modified cell comprises reduced protein expression of an NK group 2D ligand, where the NK group 2D ligand is MICA and/or MICB. In some cases, the genetically modified cell comprises reduced protein expression of an endogenous gene not expressed in a human, where the endogenous gene not expressed in a human is GGTA1, CMAH, and/or B4GALNT2. In some cases, the genetically modified cell comprises reduced protein expression of a CXCR3 ligand, where the CXCR3 ligand is CXCL10.

In some cases, the genetically modified cell further comprises one or more exogenous polynucleotides encoding one or more proteins or functional fragments thereof, where the one or more proteins or functional fragments thereof comprise: an MHC I formation suppressor, a regulator of complement activation, an inhibitory ligand for NK cells, a B7 family member, CD47, a serine protease inhibitor, and/or galectin. In some cases, the one or more proteins or functional fragments thereof are human proteins. In some cases, the genetically modified cell comprises one or more exogenous polynucleotides encoding an MHC I formation suppressor, where the MHC I formation suppressor is ICP47. In some cases, the genetically modified cell comprises comprising one or more exogenous polynucleotides encoding a regulator of complement activation, where the regulator of complement activation is CD46, CD55, and/or CD59. In some cases, the genetically modified cell comprises one or more exogenous polynucleotides encoding an inhibitory ligand for NK cells, where the inhibitory ligands for NK cells is HLA-E, HLA-G, and/or B2M. In some cases, the genetically modified cell comprises the inhibitory ligands for NK cells is HLA-G, and the HLA-G is HLA-G1, HLA-G2, HLA-G3, HLA-G4, HLA-G5, HLA-G6, and/or HLA-G7. In some cases, the genetically modified cell comprises one or more exogenous polynucleotides encoding a B7 family member, where the B7 family member is a programmed death-ligand. In some cases, the HLA-G is HLA-G1. In some cases, the programmed death-ligand is programmed death-ligand 1 (PD-L1) and/or programmed death-ligand 2 (PD-L2). In some cases, the programmed death-ligand is both PD-L1 and PD-L2. In some cases, the genetically modified cell comprises one or more exogenous polynucleotides encoding a serine protease inhibitor, where the serine protease inhibitor is serine protease inhibitor 9 (Spi9). In some cases, the genetically modified cell comprises one or more exogenous polynucleotides encoding galectin, where the galectin is galectin-9.

In some cases, the genetically modified cell comprises reduced protein expression of NLRC5 or TAP1, C3, CXCL10, GGTA1, CMAH, and/or B4GALNT2; and/or exogenous polynucleotides encoding i) HLA-G1, HLA-E, or a functional fragment thereof, ii) PD-L1 or a functional fragment thereof, iii) PD-L2 or a functional fragment thereof, and/or iv) CD47 or a functional fragment thereof. In some cases, the one or more exogenous polynucleotides are inserted adjacent to a ubiquitous promoter. In some cases, the ubiquitous promoter is a Rosa26 promoter. In some cases, the one or more exogenous polynucleotides are inserted adjacent to a promoter of a targeted gene or within the targeted gene. In some cases, the targeted gene is one of the first genes or one of the second genes. In some cases, the protein expression of the one or more first genes is reduced using a CRISPR/cas system. In some cases, the protein expression of the one or more second genes is reduced using a CRISPR/cas system.

In another aspect, disclosed herein is a genetically modified cell from a member of the Laurasiatheria superorder or a non-human primate, comprising: a) an exogenous polynucleotide encoding an inhibitory ligand for an NK cell or a functional fragment thereof, and b) reduced protein expression of an endogenous gene, where the reduced protein expression is in comparison to a non-genetically modified counterpart cell.

In some cases, the inhibitory ligand for an NK cell is HLA-E or HLA-G. In some cases, the inhibitory ligand for an NK cell is HLA-G, and the HLA-G is HLA-G1, HLA-G2, HLA-G3, HLA-G4, HLA-G5, HLA-G6, or HLA-G7. In some cases, the HLA-G is HLA-G1. In some cases, the endogenous gene is not expressed in a human. In some cases, the endogenous gene is GGTA1, CMAH, and/or B4GALNT2. In some cases, the genetically modified cell further comprises exogenous polynucleotides encoding: a) PD-L1 or a functional fragment thereof, b) PD-L2 or a functional fragment thereof, and/or c) CD47 or a functional fragment thereof. In some cases, the exogenous polynucleotides are inserted adjacent to a ubiquitous promoter. In some cases, the ubiquitous promoter is a Rosa26 promoter. In some cases, the exogenous polynucleotides are inserted adjacent to a promoter of the endogenous gene, or within the endogenous gene. In some cases, the protein expression of the endogenous genes is reduced using a CRISPR/cas system. In some cases, the genetically modified cell is a pancreatic, kidney, eye, liver, small bowel, lung, or heart cell. In some cases, the genetically modified cell is a pancreatic islet cell. In some cases, the pancreatic islet cell is a pancreatic β cell. In some cases, the genetically modified cell is a spleen, liver, peripheral blood, lymph nodes, thymus, or bone marrow cell. In some cases, the genetically modified cell is a porcine cell. In some cases, the genetically modified cell is from an embryonic tissue, a non-human fetal animal, perinatal non-human animal, neonatal non-human animal, preweaning non-human animal, young adult non-human animal, or adult non-human animal.

In another aspect, also disclosed herein is vaccine suitable for use in generating tolerance in a subject to transplanting a cell, tissue or organ which comprises an injectable composition comprising cells as defined in the application. Disclosed herein also includes a tolerizing vaccine comprising the genetically modified cell described in the application. In some cases, the genetically modified cell is an apoptotic cell. In some cases, the genetically modified cell is a fixed cell. In some cases, the vaccine further comprises a non-fixed cell. In some cases, the fixed cell and the non-fixed cell are genetically identical. In some cases, the fixed cell is fixed by a chemical and/or the fixed cell induces anergy of immune cells in the subject. In some cases, the genetically modified cell is an 1-Ethyl-3-(3-imethylaminopropyl)carbodiimide (ECDI)-fixed cell.

In another aspect, disclosed herein is a tissue or organ comprising the genetically modified cell described in the application.

In another aspect, disclosed herein is a pancreas or pancreatic islet comprising the genetically modified cell described herein.

In another aspect, disclosed herein is a pharmaceutical composition comprising the genetically modified cell described herein and a pharmaceutically acceptable excipient.

In another aspect, disclosed herein is a genetically modified cell, tissue, or organ comprising a genetically modified cell for use in transplanting to a subject in need thereof to treat a condition in the subject, where the subject is tolerized to the genetically modified cell, tissue, or organ by use of a vaccine. In some cases, the subject is administered one or more pharmaceutical agents that inhibit T cell activation, B cell activation, and/or dendritic cell activation.

In another aspect, disclosed herein is a method for treating a condition in a subject in need thereof comprising a) transplanting the genetically modified cell, tissue or organ described in the application; b) administering a vaccine described in the application to the subject; and/or c) administering one or more pharmaceutical agents that inhibit T cell activation, B cell activation, and/or dendritic cell activation to the subject.

In another aspect, disclosed herein is a method for treating a condition in a subject in need thereof comprising: a) administering a vaccine to the subject; and b) transplanting a genetically modified cell, tissue, or organ comprising a genetically modified cell to the subject. In some cases, administering to the subject one or more pharmaceutical agents that inhibits T cell activation, B cell activation, and/or dendritic cell activation. In some cases, the transplanted genetically modified cell is the genetically modified cell described in the application. In some cases, the vaccine is the vaccine described in the application. In some cases, the vaccine comprises from or from about 0.001 to 1.0 endotoxin unit per kg bodyweight of the subject. In some cases, the vaccine comprises from or from about 1 to 10 aggregates per µl. In some cases, the vaccine is administered 7 days before the transplantation and 1 day after the transplantation. In some cases, the vaccine comprises at least from or from about $1 \times 10^8$ to $4 \times 10^8$ splenocytes or splenic B cells per kg bodyweight of the subject. In some cases, the splenocytes or splenic B cells comprise from or from about 80% to 100% CD21 positive SLA Class II positive B cells. In some cases, the vaccine is provided intravenously. In some cases, the transplanted cell, tissue, or organ is functional for at least 7 days after transplanted to the subject. In some cases, the transplanting is xenotransplanting. In some cases, the pharmaceutical agent comprises a first dose of an anti-CD40 antibody. In some cases, the first dose is given to the subject about 8 days before the transplantation. In some cases, the first dose comprises from or from about 30 mg to 70 mg of anti-CD40 antibody per kg body weight of the subject. In some cases, the method further comprises administering one or more additional immunosuppression agents to the subject. In some cases, the one or more additional immunosuppression agents comprise a B-cell depleting antibody, an mTOR inhibitor, a TNF-alpha inhibitor, an IL-6 inhibitor, a complement C3 or C5 inhibitor, and/or a nitrogen mustard alkylating agent. In some cases, one of the additional immunosuppression agents is a nitrogen mustard alkylating agent. In some cases, one of the nitrogen mustard alkylating agent is cyclophosphamide. In some cases, the cyclophosphamide is administered 2 or 3 days after the administration of the vaccine.

In some cases, where the cyclophosphamide is administered at a dose of from or from about 50 mg/kg/day and 60 mg/kg/day. In some cases, the subject is a human subject. In some cases, the subject is a non-human animal. In some cases, the non-human animal is a cat or a dog. In some cases, the condition is a disease. In some cases, the disease is diabetes. In some cases, the diabetes is type 1 diabetes, type 2 diabetes, surgical diabetes, cystic fibrosis-related diabetes, and/or mitochondrial diabetes.

In another aspect, disclosed herein is a method for immunotolerizing a recipient to a graft comprising providing to the recipient the vaccine described in the application.

In another aspect, disclosed herein is method for treating a condition in a subject in need thereof comprising transplanting the genetically modified cell described in the application.

In another aspect, disclosed herein is a genetically modified cell described in the application, or a tissue or organ comprising the genetically modified cell, for use in transplanting to a subject in need thereof to treat a condition in the subject, where the subject is tolerized to the genetically modified cell, tissue, or organ by the vaccine described in the application, and where one or more pharmaceutical agents that inhibit T cell activation, B cell activation, and/or dendritic cell activation, is administered to the subject. In some cases the transplanting is xenotransplanting.

In another aspect, disclosed herein is a genetically modified cell described in the application, or a tissue or organ comprising the genetically modified cell, for use in administering to a subject in need thereof to treat a condition in the subject.

In another aspect, disclosed herein is a vaccine described in the application for use in immunotolerizing a recipient to a graft.

In another aspect, disclosed herein is a method for making a genetically modified animal described in the application, comprising: a) obtaining a cell with reduced expression of one or more of a component of a MHC I-specific enhanceosome, a transporter of a MHC I-binding peptide, and/or C3; b) generating an embryo from the cell; and c) growing the embryo into the genetically modified animal. In some cases, the cell is a zygote.

In another aspect, disclosed herein is a method for making a genetically modified animal described in the application, comprising: a) obtaining a first cell with reduced expression of one or more of a component of a MHC I-specific enhanceosome, a transporter of a MHC I-binding peptide, and/or C3; b) transferring a nucleus of the first cell to a second cell to generate an embryo; and c) growing the embryo to the genetically modified animal. In some cases, the reducing is performed by gene editing. In some cases, the gene editing is performed using a CRISPR/cas system.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 7A shows a cloning strategy and oligonucleotides (SEQ ID NOs: 199-200, respectively, in order of appearance) for making a guide RNA targeting GGTA1. FIG. 7B shows an insertion site on the px330 plasmid (SEQ ID NO: 201). FIG. 7C shows a flow chart demonstrating the cloning and verification strategy. FIG. 7D shows a cloning site (SEQ ID NO: 203) and sequencing primers (SEQ ID NOs: 202 and 204, respectively, in order of appearance). FIG. 7E shows sequencing results (SEQ ID NOs: 205-207, respectively, in order of appearance).

FIG. 8A shows a cloning strategy and oligonucleotides (SEQ ID NOs: 208-209, respectively, in order of appearance) for making a guide RNA targeting CMAH1. FIG. 8B shows an insertion site on the px330 plasmid (SEQ ID NO: 210). FIG. 8C shows a flow chart demonstrating the cloning and verification strategy. FIG. 8D shows a cloning site (SEQ ID NO: 212) and sequencing primers (SEQ ID NOs: 211 and 213, respectively, in order of appearance). FIG. 8E shows sequencing results (SEQ ID NOs: 214-216, respectively, in order of appearance).

FIG. 9A shows a cloning strategy and oligonucleotides (SEQ ID NOs: 217-218, respectively, in order of appearance) for making a guide RNA targeting NLRC5. FIG. 9B shows an insertion site on the px330 plasmid (SEQ ID NO: 219). FIG. 9C shows a flow chart demonstrating the cloning and verification strategy. FIG. 9D shows a cloning site (SEQ ID NO: 221) and sequencing primers (SEQ ID NOs: 220 and 222, respectively, in order of appearance). FIG. 9E shows sequencing results (SEQ ID NOs: 223-225, respectively, in order of appearance).

Figure 10D:
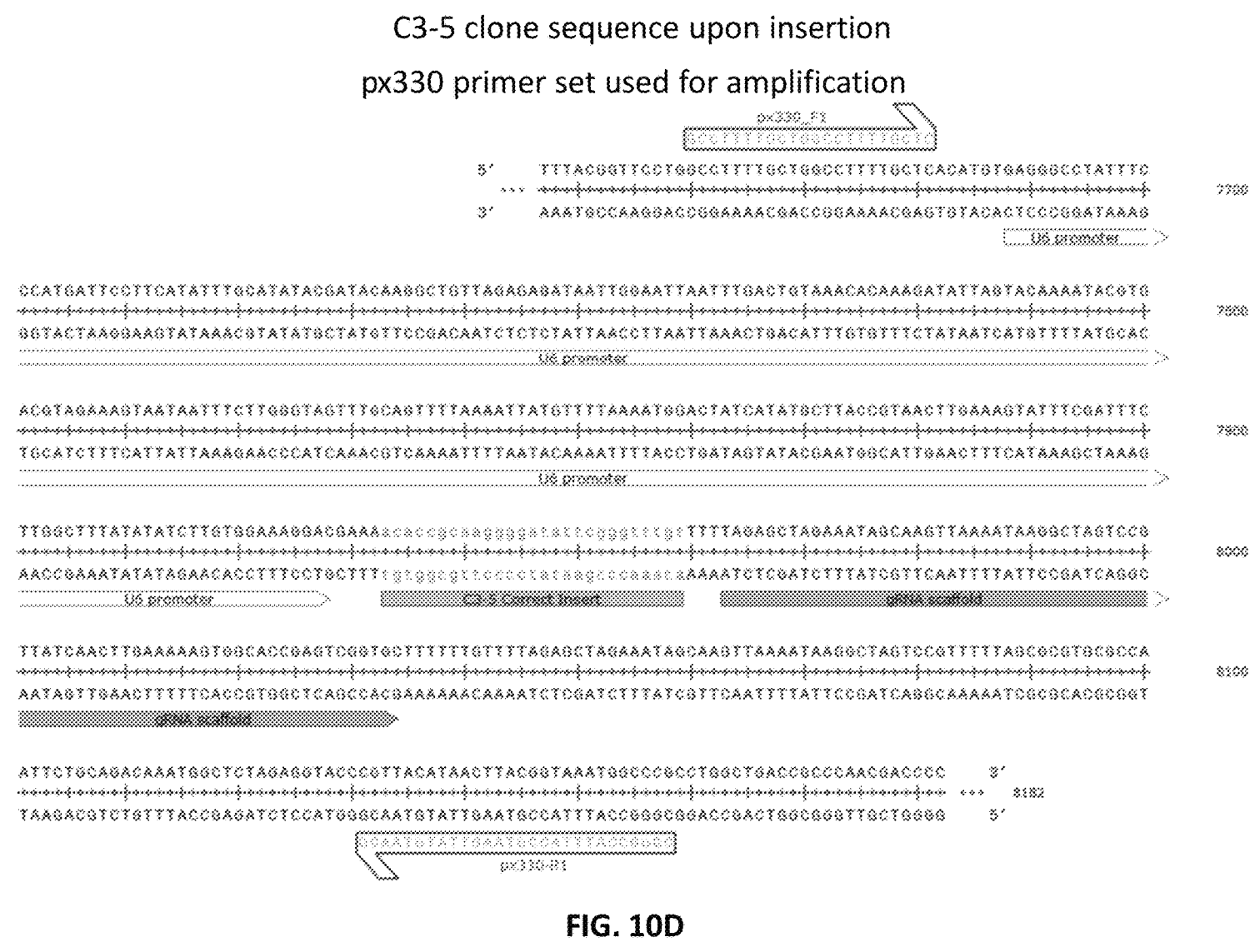

FIGS. 10A-10E demonstrate a strategy for cloning a px330/C3-5 plasmid targeting C3. FIG. 10A shows a cloning strategy and oligonucleotides (SEQ ID NOs: 226-227, respectively, in order of appearance) for making a guide RNA targeting C3. FIG. 10B shows an insertion site on the px330 plasmid (SEQ ID NO: 228). FIG. 10C shows a flow chart demonstrating the cloning and verification strategy. FIG. 10D shows a cloning site (SEQ ID NO: 230) and sequencing primers (SEQ ID NOs: 229 and 231, respectively, in order of appearance). FIG. 10E shows sequencing results (SEQ ID NOs: 232-234, respectively, in order of appearance).

Figure 11D:
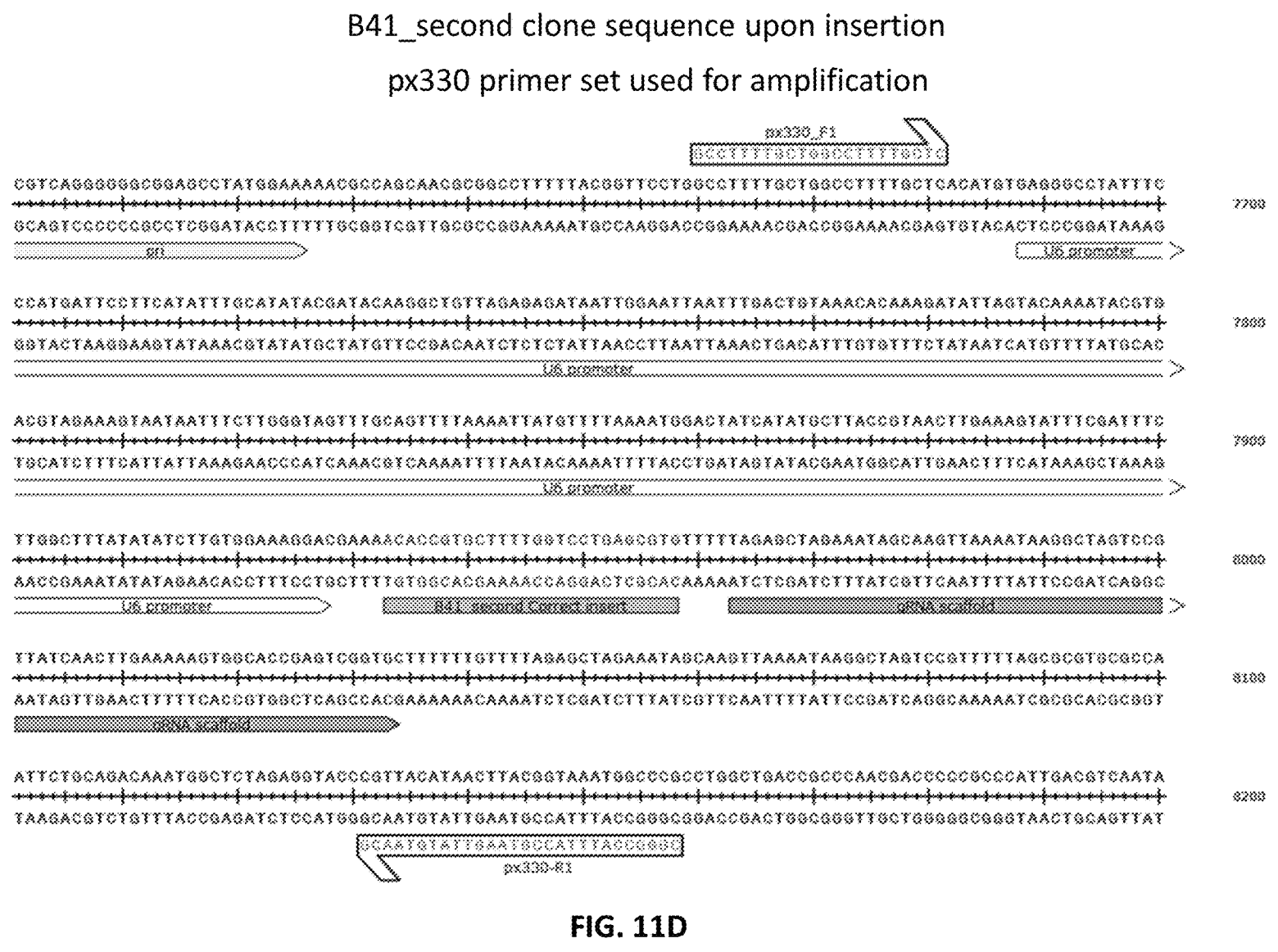

FIGS. 11A-11E demonstrate a strategy for cloning a px330/B41_second plasmid targeting B4GALNT2. FIG. 11A shows a cloning strategy and oligonucleotides (SEQ ID NOs: 235-236, respectively, in order of appearance) for making a guide RNA targeting B4GALNT2. FIG. 11B shows an insertion site on the px330 plasmid (SEQ ID NO: 237). FIG. 11C shows a flow chart demonstrating the cloning and verification strategy. FIG. 11D shows a cloning site (SEQ ID NO: 239) and sequencing primers (SEQ ID NOs: 238 and 240, respectively, in order of appearance). FIG. 11E shows sequencing results (SEQ ID NOs: 241-243, respectively, in order of appearance).

FIGS. 13A-13E demonstrate a strategy for cloning a px330/Rosa exon 1 plasmid targeting Rosa26. FIG. 13A shows a cloning strategy and oligonucleotides (SEQ ID NOs: 244-245, respectively, in order of appearance) for making a guide RNA targeting Rosa26. FIG. 13B shows an insertion site on the px330 plasmid (SEQ ID NO: 246). FIG. 13C shows a flow chart demonstrating the cloning and verification strategy. FIG. 13D shows a cloning site (SEQ ID NO: 248) and sequencing primers (SEQ ID NOs: 247 and 249, respectively, in order of appearance). FIG. 13E shows sequencing results (SEQ ID NOs: 250-252, respectively, in order of appearance).

FIG. 17A shows genetically modified cells, which do not express alpha-galactosidase. FIG. 17B shows non-genetically modified cells, which express alpha-galactosidase and were labeled with isolectin B4 (IB)-linked ferrous beads.

FIGS. 18A-18C demonstrates validation of GGTA1, CMAH, and NLRC5 disruption in pig cells. FIG. 18A demonstrates validation of GGTA1 disruption in pig cells. FIG. 18A discloses SEQ ID NOs: 253-255, respectively, in order of appearance. FIG. 18B demonstrates validation of CMAH disruption in pig cells. FIG. 18B discloses SEQ ID NOs: 256-258, respectively, in order of appearance. FIG. 18C demonstrates validation of NLRC5 disruption in pig cells. FIG. 18C discloses SEQ ID NOs: 259-261, respectively, in order of appearance.

FIGS. 19A-19B demonstrate the inhibitory effects of an anti-SLA antibody on the pig islet-induced human CD8+ T cell activation. FIG. 19A shows the proliferation of CD8+ T cells, CD4 T cells and natural killer (NK) cells in a mixed culture with adult pig islets for 7 days in the presence (black bars) or absence (white bars) of the anti-SLA antibody. FIG. 19B shows the viability (assessed by AO/PI staining) of adult pig islets cultured with or without highly purified lymphocytes for 7 days in the presence (black bars) or absence (white bars) of the anti-SLA class I antibody.

FIG. 20A demonstrates the result of ELISPOT assays. The results show the suppression of a posttransplant increase of anti-donor T cells with direct and indirect specificity secreting IFN-γ in a cynomolgus monkey. The monkey was treated with peritransplant infusion of apoptotic donor splenocytes from a GT-KO donor pig, and islets from the same donor pig on day 0 under the cover of transient immunosuppression with anti-CD40 monoclonal antibody, rapamycin, sTNFR, and anti-IL-6R monoclonal antibody. FIG. 20B demonstrates CD8 staining of an intraportally transplanted adult porcine islet undergoing rejection at 141 days after transplantation.

FIG. 21A demonstrates blood glucose levels and exogenous insulin needed to maintain normal blood glucose level before and after transplantation. FIG. 21B demonstrates serum porcine C-peptide level in a monkey. FIG. 21C demonstrates blood glucose levels in response to glucose challenges. FIG. 21D demonstrates serum porcine C-peptide levels in response to glucose challenges.

FIG. 22A demonstrates rejection of non-genetically modified porcine islets by a monkey transplanted with islets and receiving anti-CD40 antibody four times through day 14 after transplantation and maintenance immunosuppression with CTLA4-Ig and rapamycin. FIG. 22B demonstrates amelioration of diabetes by transplanted porcine islets in monkeys receiving anti-CD40 antibody four times through day 14 after transplantation and maintenance immunosuppression with CTLA4-Ig and rapamycin.

FIG. 29A or Pregnancy 2: FIG. 29B) subjected to PCR amplification of the GGTA1 (compared to Sus scrofa breed mixed chromosome 1, Sscrofa10.2 NCBI Reference Sequence: NC_010443.4) target regions and the resulting amplicons were separated on 1% agarose gels. Amplicons were also analyzed by sanger sequencing using the forward primer alone from each reaction. In FIG. 29A, the results are shown from Pregnancy 1's fetuses 1, 2, 4, 5, 6, and 7, truncated 6 nucleotides after the target site for GGTA1. Fetus 3 was truncated 17 nucleotides after the cut site followed by a 2,511 (668-3179) nucleotide deletion followed by a single base substitution. Truncation, deletion and substitution from a single sequencing experiment containing the alleles from both copies of the target gene can only suggest a gene modification has occurred but not reveal the exact sequence for each allele. From this analysis it appears that all 7 fetuses have a single allele modification for GGTA1. FIG. 29 A discloses SEQ ID NOs: 262-271, respectively, in order of appearance. FIG. 29B shows pregnancy 2 fetal DNA samples 1, 3, 4, and 5 were truncated 3 nucleotides from the GGTA1 gene target site. Fetus 2 had variability in sanger sequencing that suggests a complex variability in DNA mutations or poor sample quality. However, fetal DNA template quality was sufficient for the generation of the GGTA1 gene screening experiment described above. FIG. 29B discloses SEQ ID NOs: 272-278, respectively, in order of appearance.

Figure 30A:
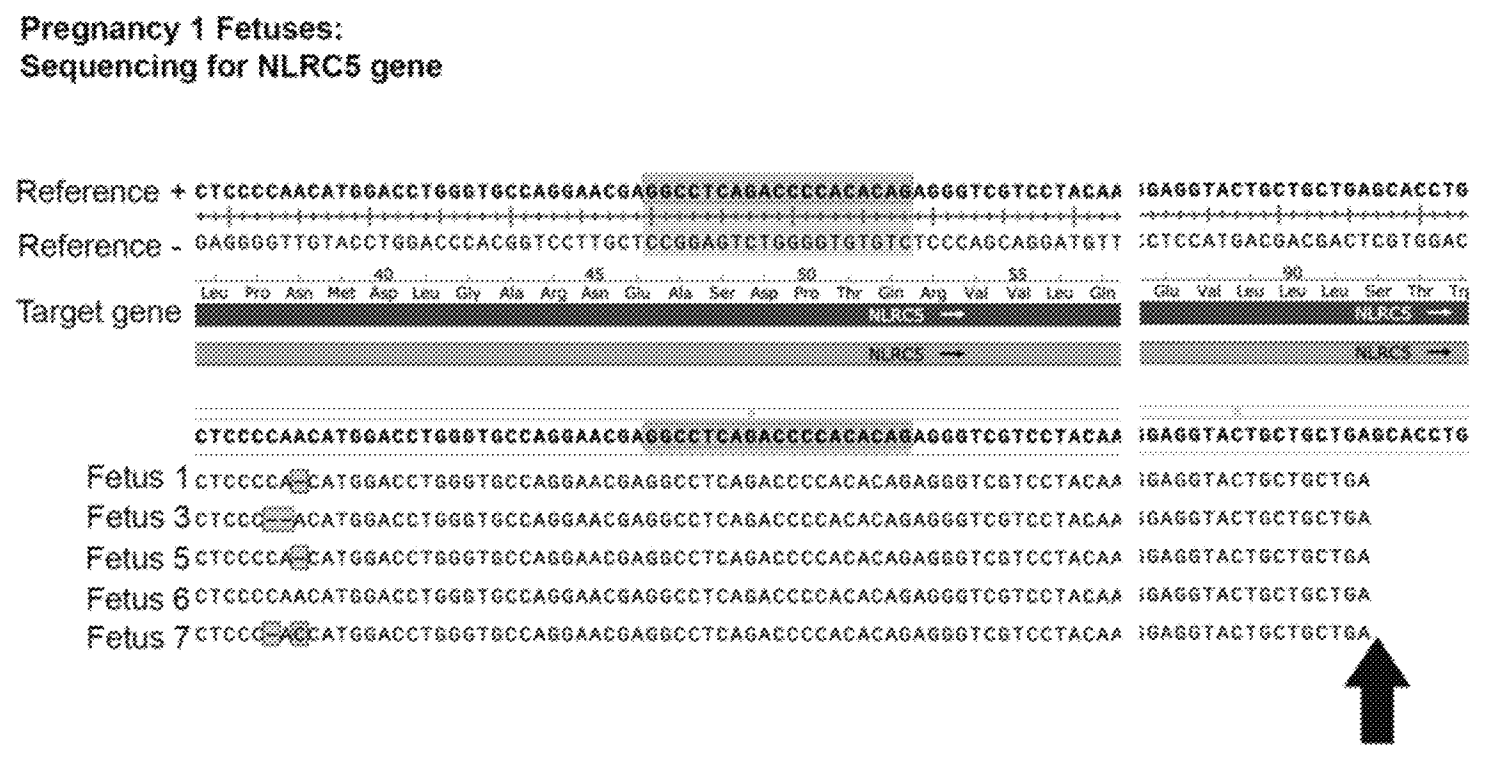
Figure 30B:
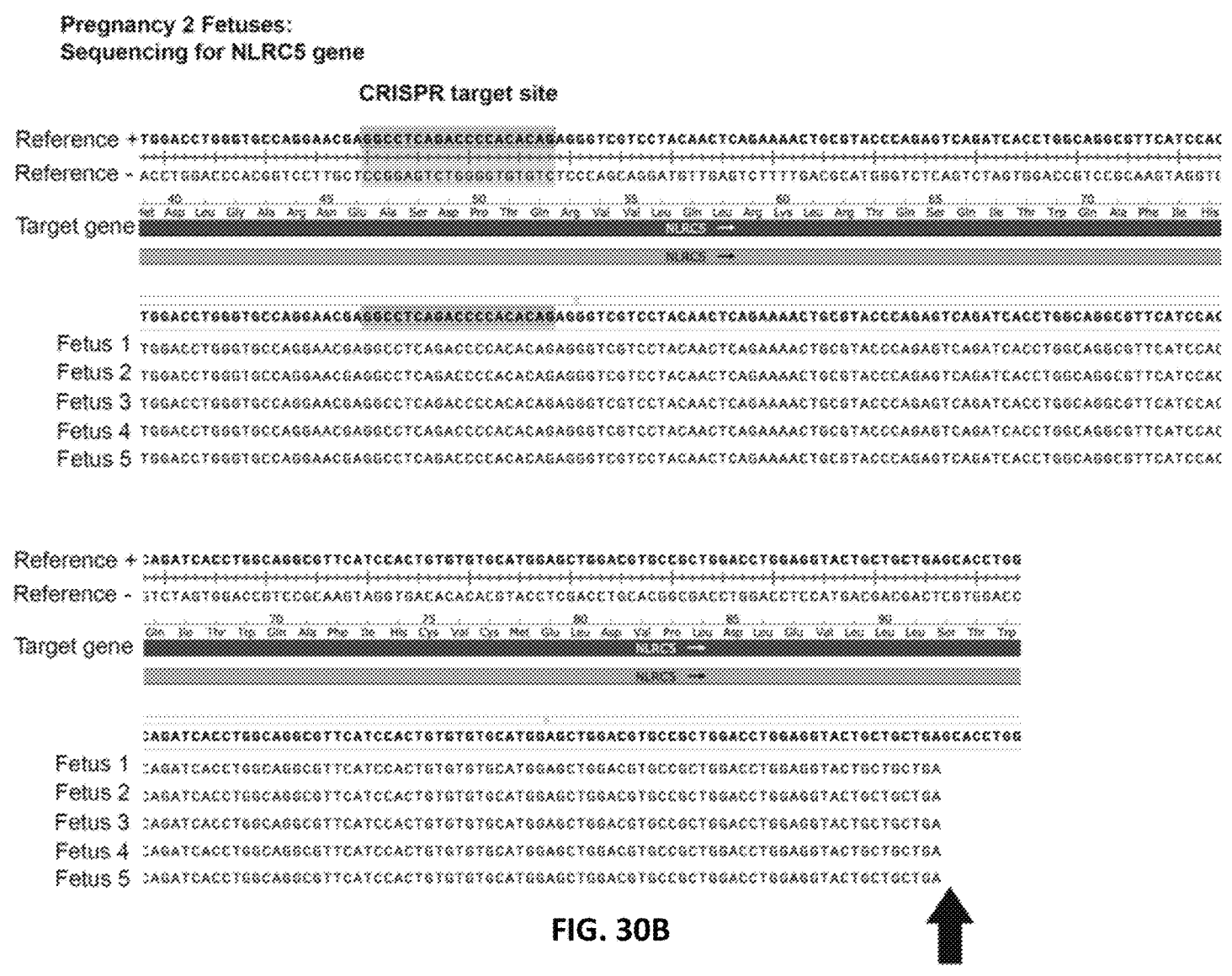

FIGS. 30A-30B show sequencing of DNA isolated from fetal cells of two separate litters (Pregnancy 1: FIG. 30A or Pregnancy 2: FIG. 30B) subjected to PCR amplification of the NLRC5 (consensus sequence) target regions and the resulting amplicons were separated on 1% agarose gels. Amplicons were also analyzed by sanger sequencing using the forward primer alone from each reaction. Sequence analysis of the NLRC5 target site for fetuses from Pregnancy 1 (FIG. 30A) was unable to show consistent alignment suggesting an unknown complication in the sequencing reaction or varying DNA modifications between NLRC5 alleles that complicate the sanger sequencing reaction and analysis. FIG. 30A discloses SEQ ID NOs: 279-294, respectively, in order of appearance. NLRC5 gene amplicons from Pregnancy 2 (FIG. 30B) were all truncated 120 nucleotides downstream of the NLRC5 gene cut site. FIG. 30B discloses SEQ ID NOs: 295-310, respectively, in order of appearance.

Figure 32A:
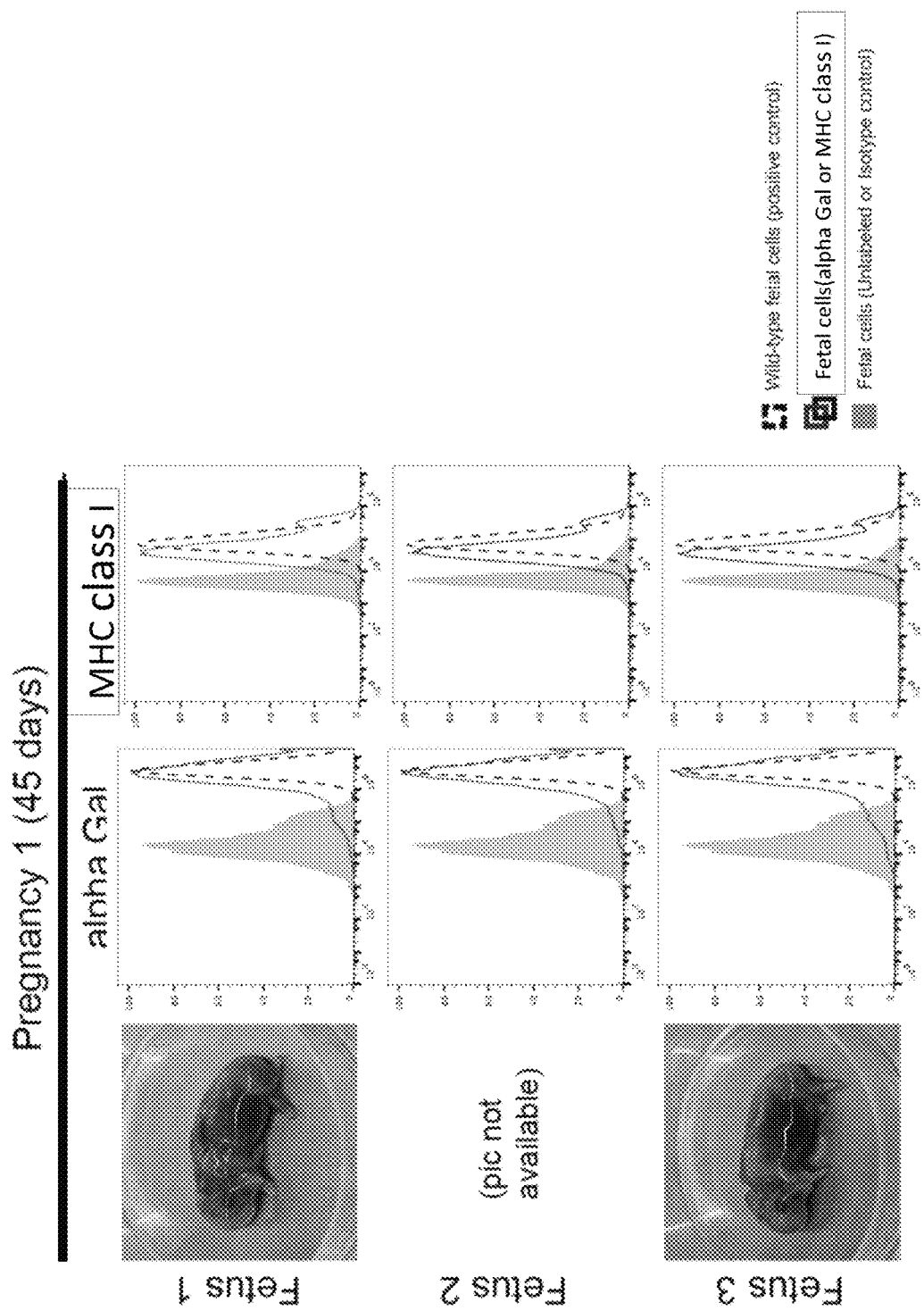
FIGS. 32A-32E shows phenotypic analysis of fetuses from two separate litters of pigs (FIGS. 32A-32C: Pregnancy 1 or FIGS. 32D-32E: Pregnancy 2). Fetuses were harvested at day 45 (Pregnancy 1) or 43 days (Pregnancy 2) and processed for DNA and culture cell isolation. Tissue fragments and cells were plated in culture media for 2 days to allow fetal cells to adhere and grow. Wild type cells (fetal cells not genetically modified) and fetal cells from pregnancy 1 and 2 were removed from culture plates and labeled with IB4 lectin conjugated to alexa fluor 488 or anti-porcine MHC class I antibody conjugated to FITC. Flow cytometric analysis is shown as histograms depicting the labeling intensity of the cells tested. The histogram for the WT cells are included in each panel to highlight the decrease in overall intensity of each group of fetal cells. There is a decrease in alpha Gal and MHC class I labeling in pregnancy 1 (FIGS. 32A-32C) indicated as a decrease in peak intensity.
Figure 32B:
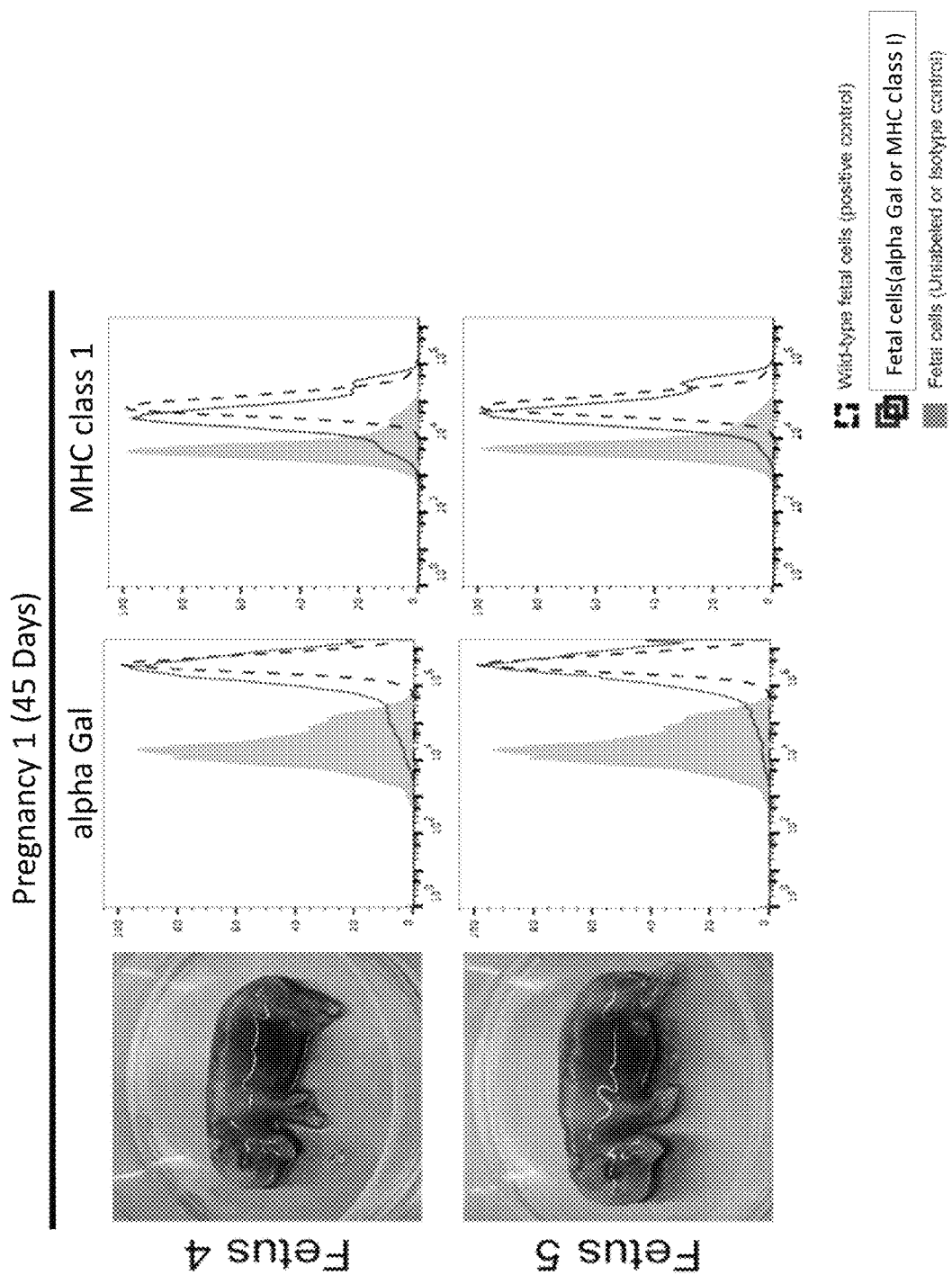
Figure 32C:
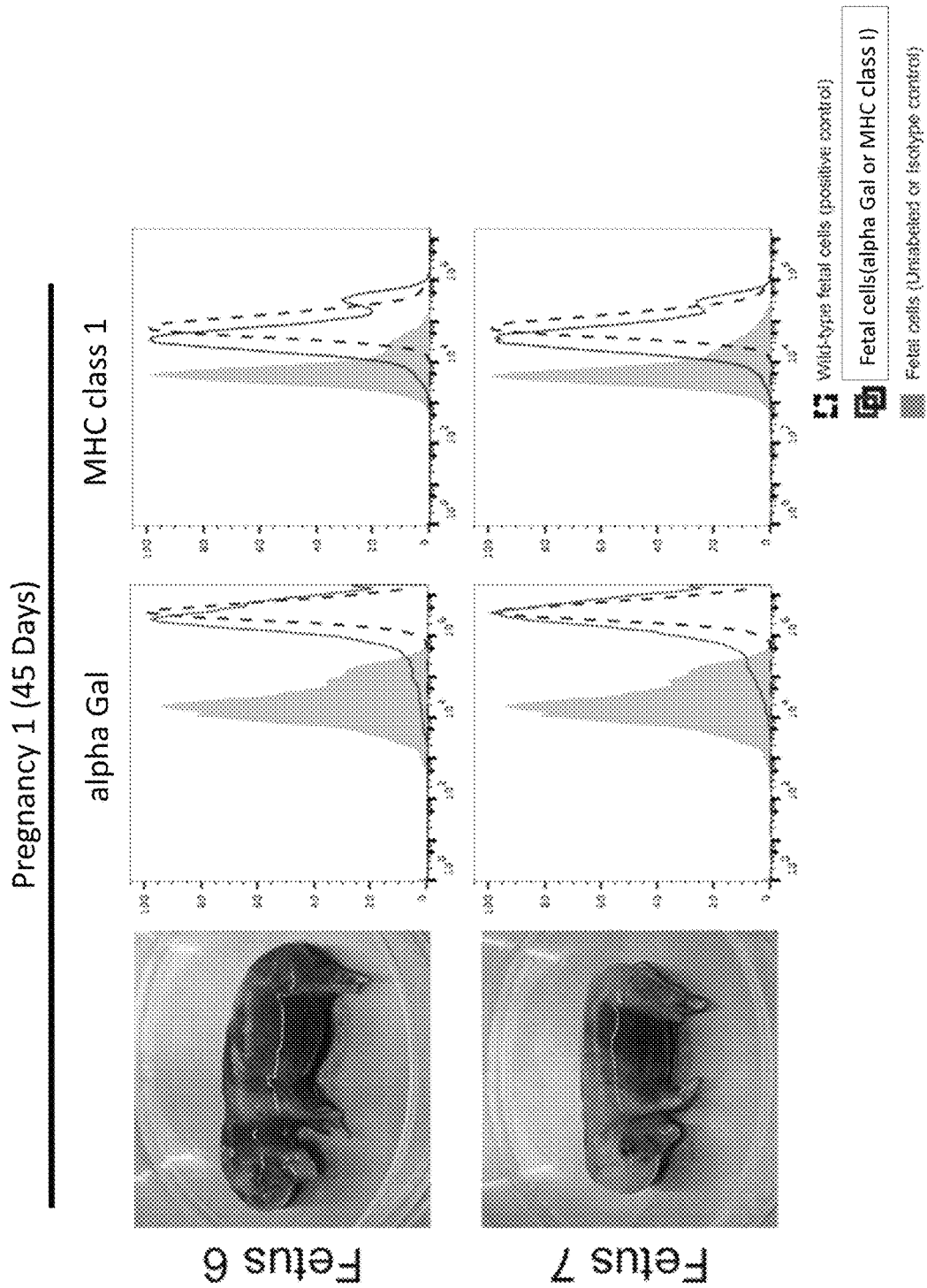
Figure 32D:
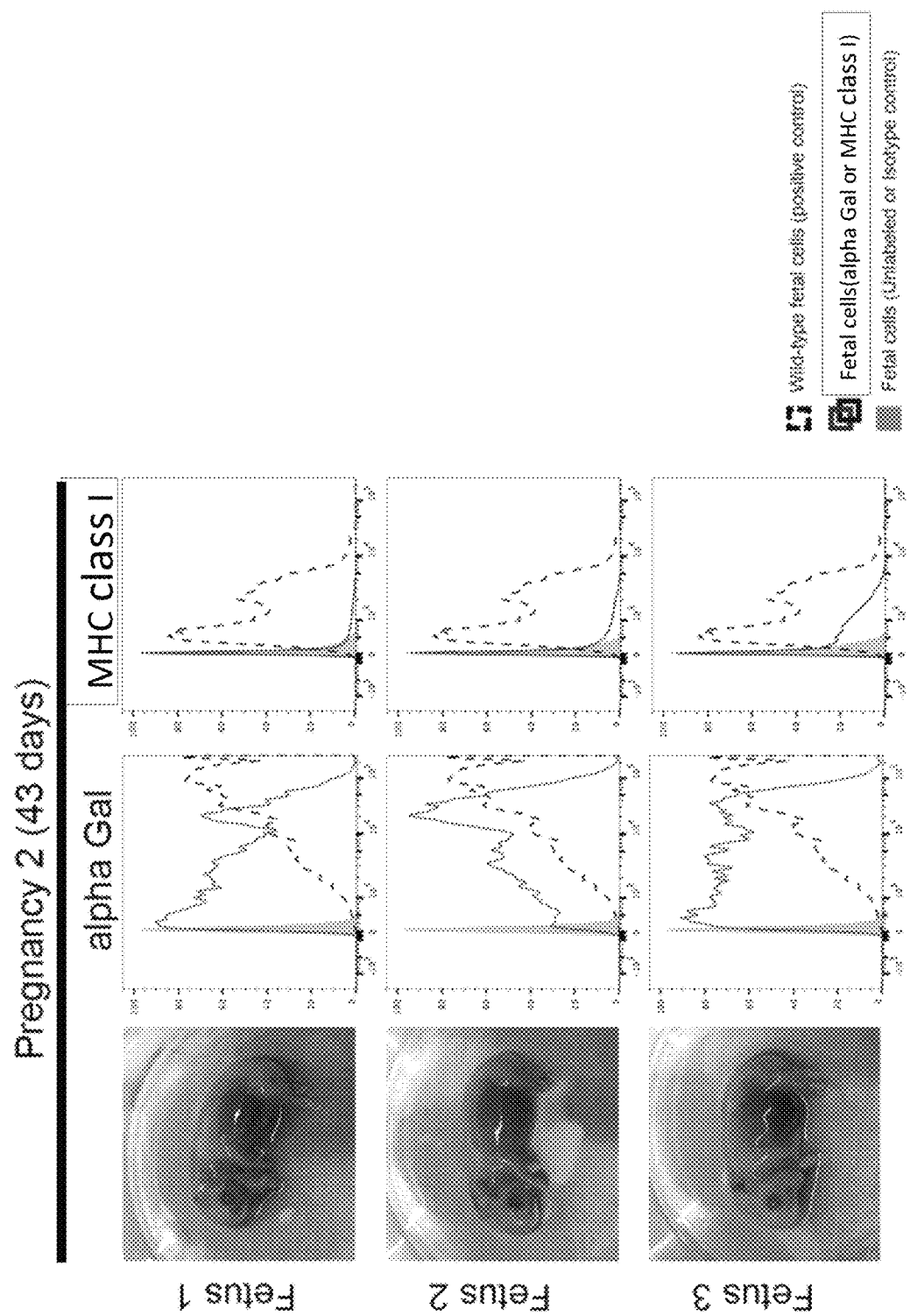
Figure 32E:
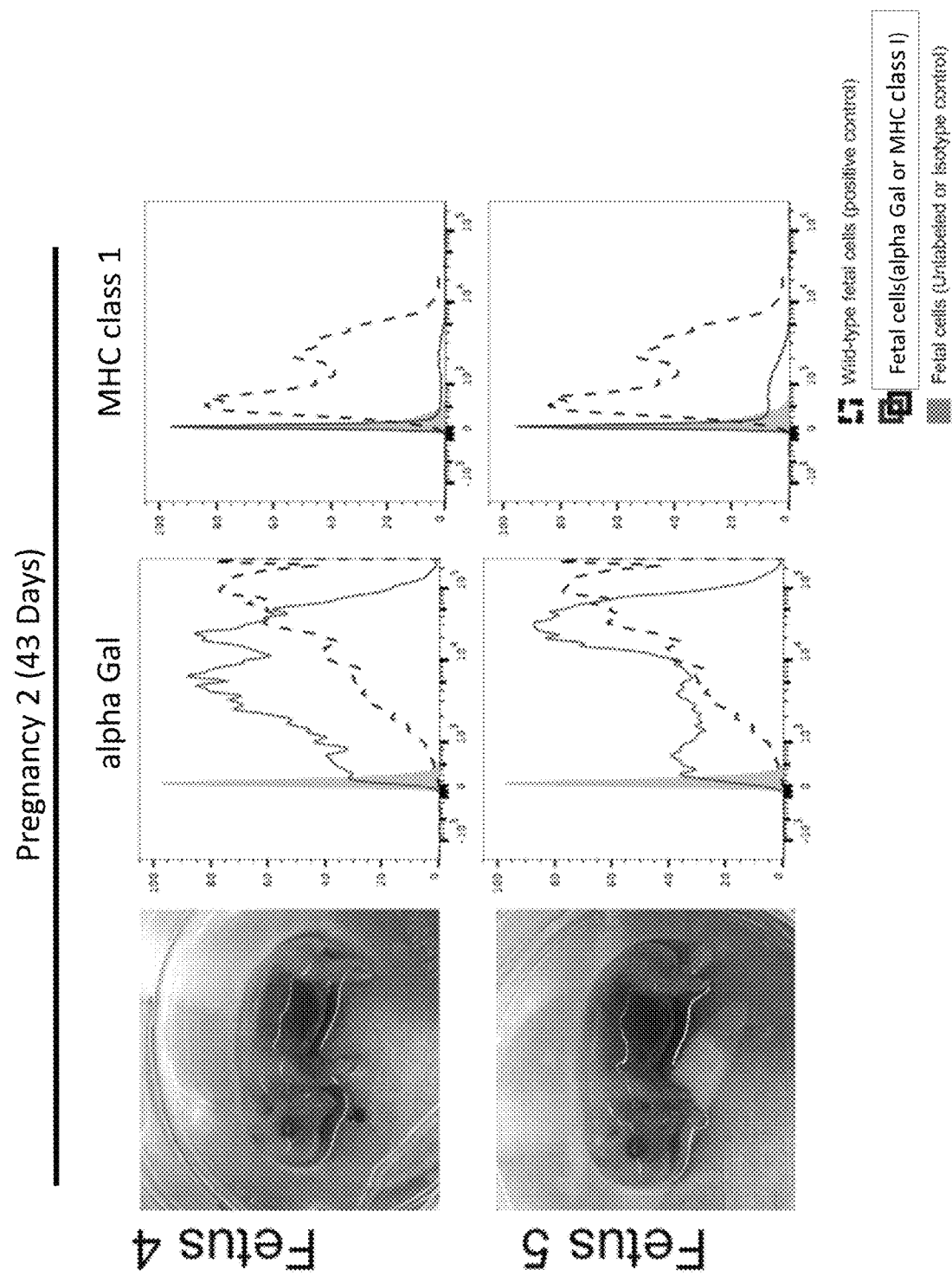

In pregnancy 2 (FIGS. 32D-32E) fetuses 1 and 3 have a large decrease in alpha gal labeling and significant reduction in MHC class 1 labeling as compared to WT fetal cells.

Figure 33A:
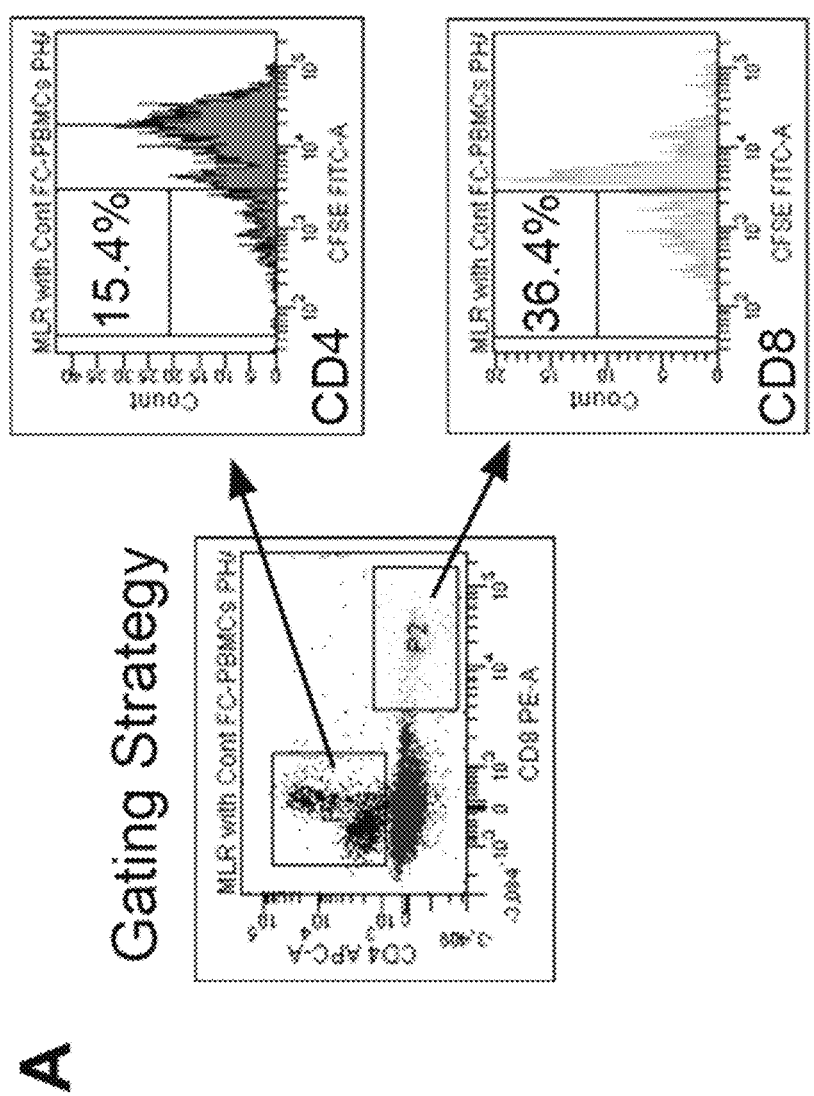
Figure 33B:
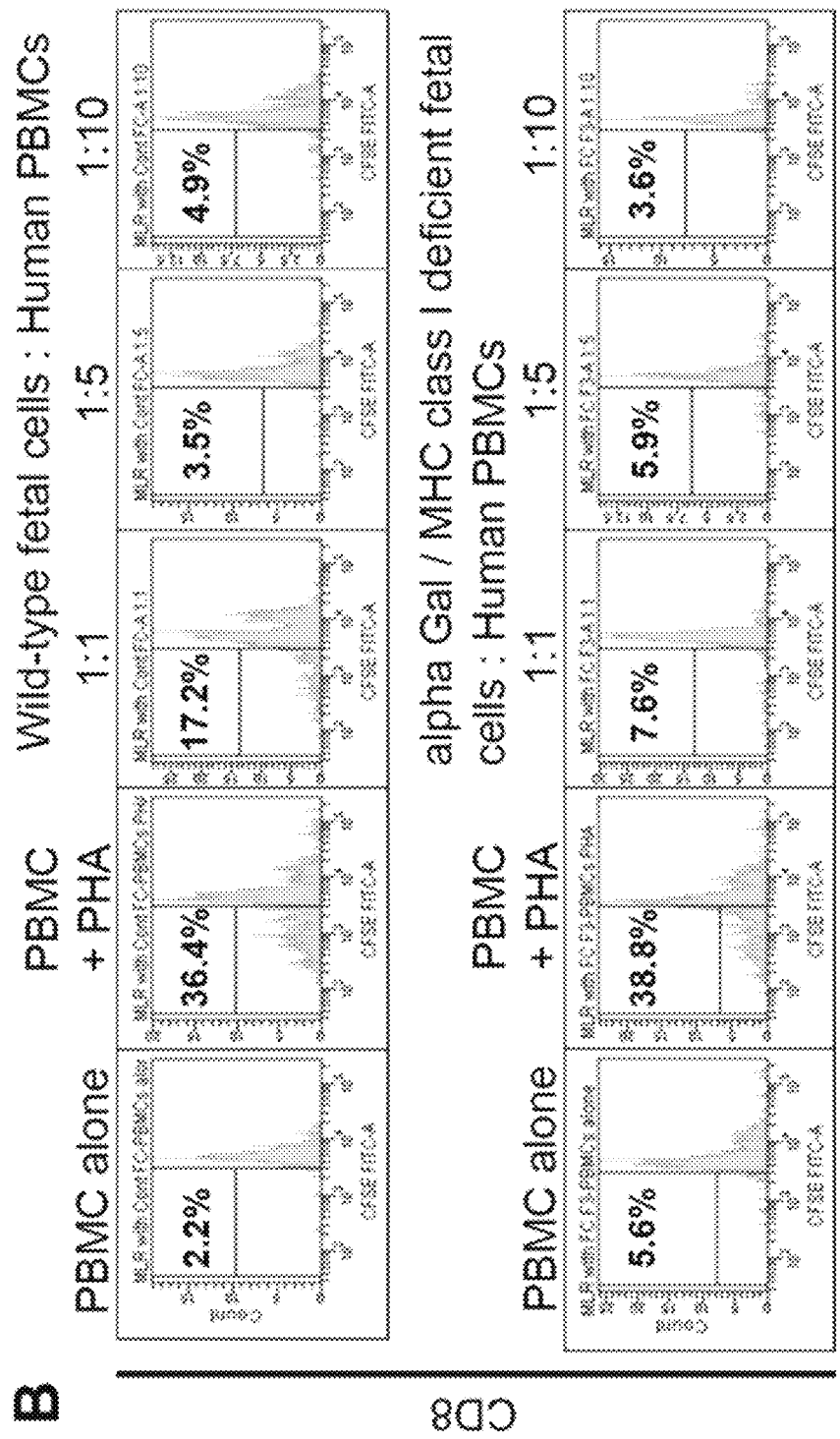
Figure 33C:
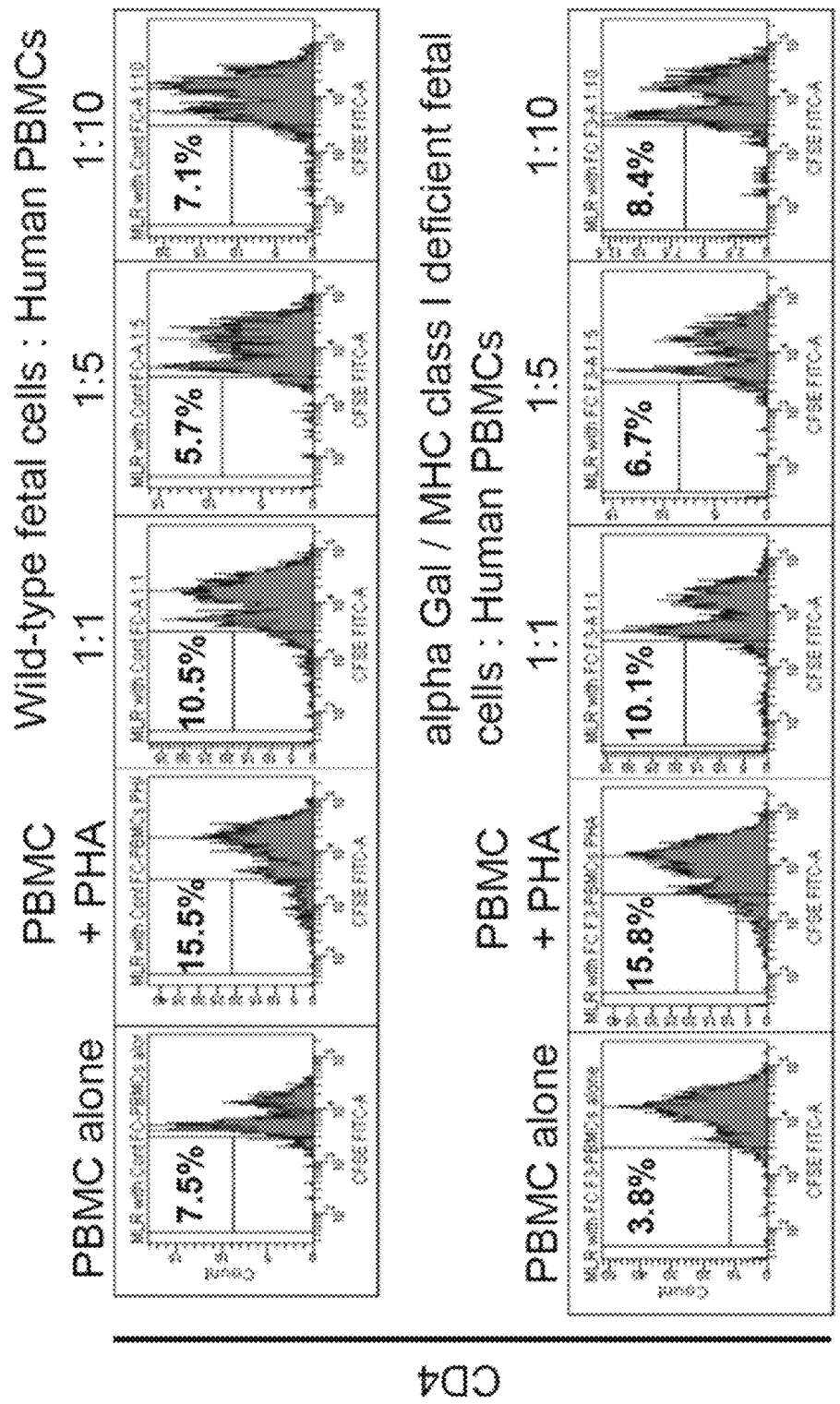

FIGS. 33A-33C shows the impact of decreased MHC class I expression in cells from Fetus 3 (Pregnancy 1) as compared to wild type fetal cells from a genetic clone. The proliferative response of human CD8+ cells and CD4 T cells to porcine control fibroblast and NLRC5 knockout fetal cells were measured. FIG. 33A. Cells were gated as CD4 or CD8 before assessment of proliferation. FIG. 33B. CD8 T cell proliferation was reduced following treatments stimulation by porcine fetal GGTA1/NLRC5 knockout cells compared to control unmodified porcine fibroblast. Almost a 55% reduction in CD8 T cells proliferation was observed when human responders were treated with porcine fetal GGTA1/NLRC5 knockout cells at 1:1 ratio. Wild type fetal cells elicited a 17.2% proliferation in human CD8 T cells whereas the MHC class I deficient cells from fetus 3 (Pregnancy 1) induced only a 7.6% proliferation. No differences were seen in CD8 T cells proliferative response at 1:5 and 1:10 ratio compared to unmodified fetal cells. FIG. 33C. No changes were observed in CD4 T cell proliferation in response to NLRC5 knockout and control unmodified porcine fetal cells at all ratios studied.

DETAILED DESCRIPTION OF THE DISCLOSURE

The following description and examples illustrate embodiments of the invention in detail. It is to be understood that this invention is not limited to the particular embodiments described herein and as such can vary. Those of skill in the art will recognize that there are numerous variations and modifications of this invention, which are encompassed within its scope.

Failure of organ and tissue function can result in premature death of individuals. Transplantation can potentially solve this problem, which can prolong the lives of many individuals. However, there is a shortage of cells, organs, and/or tissues that can be used for transplantation.

Xenografts or allografts (e.g., embryonic or induced pluripotent stem cells) can be used to create an unlimited supply of cells, organs, and/or tissues used for transplantation. In general, some transplantation can lead to increased immune response which can ultimately lead to transplantation rejection. Isografts or autografts typically do not result in rejection. However, allografts and xenografts can result in immune reaction and can ultimately lead to the destruction of the graft. The risk of rejection in some cases can be mitigated by suppressing the immune response.

Traditionally, immunosuppressive drugs were used after transplantation. However, there are many detrimental effects associated with long-term treatment with immunosuppressive drugs, including but not limited to increased risk of cancer and infection. Alternative methods to prevent graft rejection and suppress the immune system were sought. The immune response can be tempered by use of various techniques, including those described herein. For example, one method described herein to prevent transplantation rejection or prolong the time to transplantation rejection without or with minimal immunosuppressive drug use, an animal, e.g., a donor non-human animal, could be altered, e.g., genetically. Subsequently, the cells, organs, and/or tissues of the altered animal, e.g., a donor non-human animal, can be harvested and used in allografts or xenografts. Alternatively, cells can be extracted from an animal, e.g., a human or non-human animal (including but not limited to primary cells) or cells can be previously extracted animal cells, e.g., cell lines. These cells can be used to create a genetically altered cell.

Figure 1:
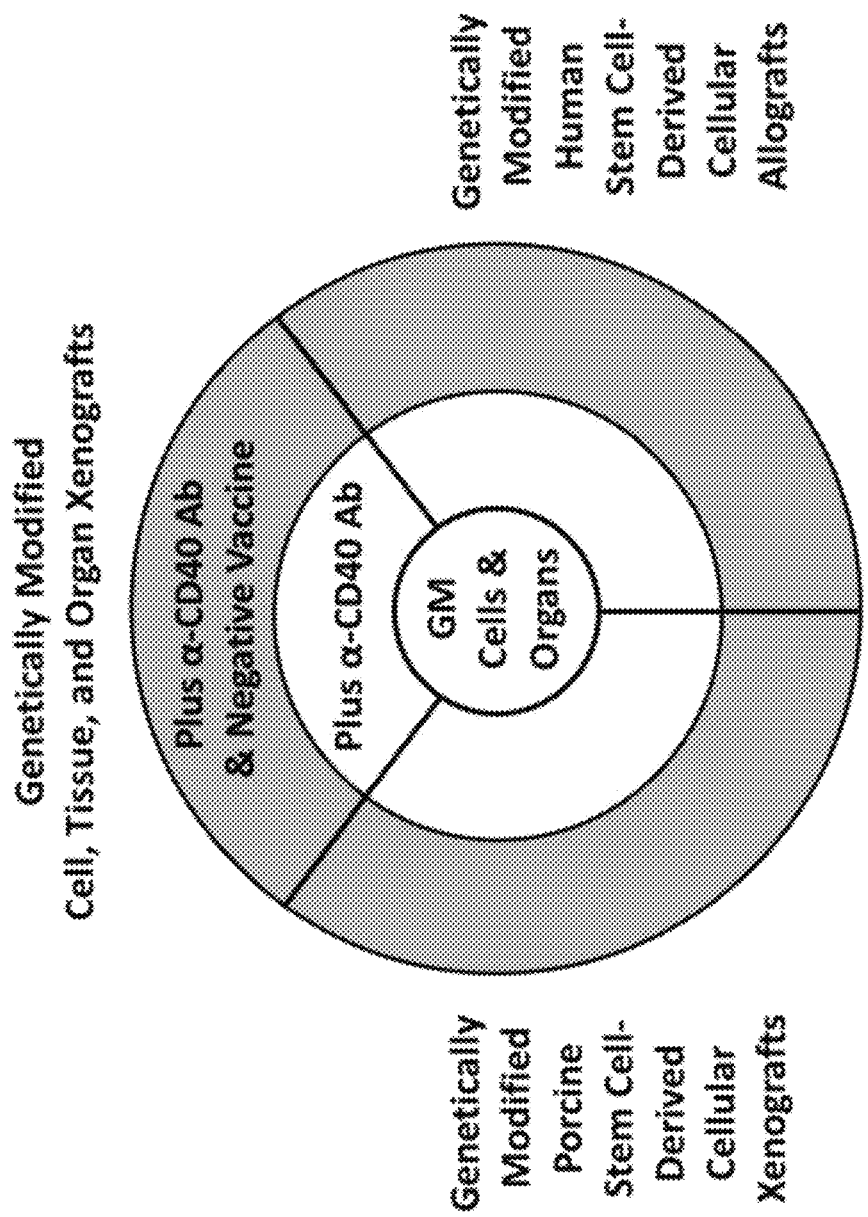
FIG. 1 demonstrates an immunotherapeutic strategy centered around the use of genetically modified cell and organ grafts lacking functional expression of MHC class I. The need for maintenance immunosuppression required for the prevention of graft rejection is progressively reduced (or the applicability of transplantation of cell and organ xenografts and the transplantation of stem cell-derived cellular allografts and xenografts is progressively increased) when the transplantation of genetically modified cells and organs is combined with transient use of antagonistic anti-CD40 antibodies and even more when combined with the administration of tolerizing vaccines comprising apoptotic donor cells under the cover of anti-CD40 antibodies.
Figure 2:
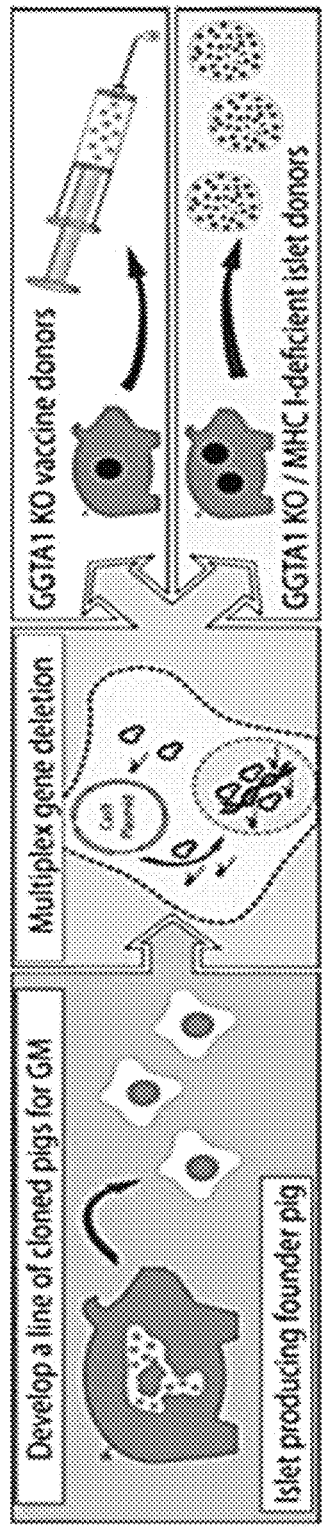
FIG. 2 demonstrates one strategy of making genetically modified pig islet cells and tolerizing vaccines. Two clonal populations of pigs are created. One population having at least GGTA1 knocked out can be used to create a tolerizing vaccine. The other clonal population of pigs that have at least GGTA1 and MHC I genes (e.g., NRLC5) knocked out, can be used for cell, tissues, and/or organ donors.

Transplant rejection (e.g., T cells-mediated transplant rejection) can be prevented by chronic immunosuppression. However, immunosuppression is costly and associated with the risk of serious side effects. To circumvent the need for chronic immunosuppression, a multifaceted, T cell-targeted rejection prophylaxis was developed (FIG. 1) that
   i) utilizes genetically modified grafts lacking functional expression of MHC class I, thereby interfering with activation of $CD8^+$ T cells with direct specificity and precluding cytolytic effector functions of these $CD8^+$ T cells,
   ii) interferes with B cell (and other APC)-mediated priming and memory generation of anti-donor T cells using induction immunotherapy comprising antagonistic anti-CD40 mAbs (and depleting anti-CD20 mAbs and a mTOR inhibitor), and/or
   iii) deletes anti-donor T cells with indirect specificity via peritransplant infusions of apoptotic donor cell vaccines.

Described herein are genetically modified non-human animals (such as non-human primates or a genetically modified animal that is member of the Laurasiatheria superorder, e.g., ungulates) and organs, tissues, or cells isolated therefrom, tolerizing vaccines, and methods for treating or preventing a disease in a recipient in need thereof by transplantation of an organ, tissue, or cell isolated from a non-human animal. An organ, tissue, or cell isolated from a non-human animal (such as non-human primates or a genetically modified animal that is member of the Laurasiatheria superorder, e.g., ungulates) can be transplanted into a recipient in need thereof from the same species (an allotransplant) or a different species (a xenotransplant). A recipient can be tolerized with a tolerizing vaccine and/or one or more immunomodulatory agents (e.g., an antibody). In embodiments involving xenotransplantation the recipient can be a human. Suitable diseases that can be treated are any in which an organ, tissue, or cell of a recipient is defective or injured, (e.g., a heart, lung, liver, vein, skin, or pancreatic islet cell) and a recipient can be treated by transplantation of an organ, tissue, or cell isolated from a non-human animal.

Definitions

The term "about" in relation to a reference numerical value and its grammatical equivalents as used herein can include the numerical value itself and a range of values plus or minus 10% from that numerical value. For example, the amount "about 10" includes 10 and any amounts from 9 to 11. For example, the term "about" in relation to a reference numerical value can also include a range of values plus or minus 10%, 9%, 8%, 7%, 6%, 5%, 4%, 3%, 2%, or 1% from that value.

The term "non-human animal" and its grammatical equivalents as used herein includes all animal species other than humans, including non-human mammals, which can be a native animal or a genetically modified non-human animal. A non-human mammal includes, an ungulate, such as an even-toed ungulate (e.g., pigs, peccaries, hippopotamuses, camels, llamas, chevrotains (mouse deer), deer, giraffes, pronghorn, antelopes, goat-antelopes (which include sheep, goats and others), or cattle) or an odd-toed ungulate (e.g., horse, tapirs, and rhinoceroses), a non-human primate (e.g., a monkey, or a chimpanzee), a Canidae (e.g., a dog) or a cat. A non-human animal can be a member of the Laurasiatheria superorder. The Laurasiatheria superorder can include a group of mammals as described in Waddell et al., *Towards*

*Resolving the Interordinal Relationships of Placental Mammals.* Systematic Biology 48 (1): 1-5 (1999). Members of the Laurasiatheria superorder can include Eulipotyphla (hedgehogs, shrews, and moles), Perissodactyla (rhinoceroses, horses, and tapirs), Carnivora (carnivores), Cetartiodactyla (artiodactyls and cetaceans), Chiroptera (bats), and Pholidota (pangolins). A member of Laurasiatheria superorder can be an ungulate described herein, e.g., an odd-toed ungulate or even-toed ungulate. An ungulate can be a pig. A member can be a member of Carnivora, such as a cat, or a dog. In some cases, a member of the Laurasiatheria superorder can be a pig.

The term "pig" and its grammatical equivalents as used herein can refer to an animal in the genus *Sus*, within the Suidae family of even-toed ungulates. For example, a pig can be a wild pig, a domestic pig, mini pigs, a *Sus scrofa* pig, a *Sus scrofa domesticus* pig, or inbred pigs.

The term "transgene" and its grammatical equivalents as used herein can refer to a gene or genetic material that can be transferred into an organism. For example, a transgene can be a stretch or segment of DNA containing a gene that is introduced into an organism. When a transgene is transferred into an organism, the organism can then be referred to as a transgenic organism. A transgene can retain its ability to produce RNA or polypeptides (e.g., proteins) in a transgenic organism. A transgene can comprise a polynucleotide encoding a protein or a fragment (e.g., a functional fragment) thereof. The polynucleotide of a transgene can be an exogenous polynucleotide. A fragment (e.g., a functional fragment) of a protein can comprise at least or at least about 5%, 10%, 20%, 30%, 40%, 50%, 60%, 70%, 80%, 90%, 95%, or 99% of the amino acid sequence of the protein. A fragment of a protein can be a functional fragment of the protein. A functional fragment of a protein can retain part or all of the function of the protein.

The term "genetic modification" and its grammatical equivalents as used herein can refer to one or more alterations of a nucleic acid, e.g., the nucleic acid within an organism's genome. For example, genetic modification can refer to alterations, additions, and/or deletion of genes. A genetically modified cell can also refer to a cell with an added, deleted and/or altered gene. A genetically modified cell can be from a genetically modified non-human animal. A genetically modified cell from a genetically modified non-human animal can be a cell isolated from such genetically modified non-human animal. A genetically modified cell from a genetically modified non-human animal can be a cell originated from such genetically modified non-human animal. For example, a cell The term "islet" or "islet cells" and their grammatical equivalents as used herein can refer to endocrine (e.g., hormone-producing) cells present in the pancreas of an organism. For example, islet cells can comprise different types of cells, including, but not limited to, pancreatic α cells, pancreatic β cells, pancreatic δ cells, pancreatic F cells, and/or pancreatic ε cells. Islet cells can also refer to a group of cells, cell clusters, or the like.

The term "condition" condition and its grammatical equivalents as used herein can refer to a disease, event, or change in health status.

The term "diabetes" and its grammatical equivalents as used herein can refer to is a disease characterized by high blood sugar levels over a prolonged period. For example, the term "diabetes" and its grammatical equivalents as used herein can refer to all or any type of diabetes, including, but not limited to, type 1, type 2, cystic fibrosis-related, surgical, gestational diabetes, and mitochondrial diabetes. In some cases, diabetes can be a form of hereditary diabetes.

The term "phenotype" and its grammatical equivalents as used herein can refer to a composite of an organism's observable characteristics or traits, such as its morphology, development, biochemical or physiological properties, phenology, behavior, and products of behavior. Depending on the context, the term "phenotype" can sometimes refer to a composite of a population's observable characteristics or traits.

The term "disrupting" and its grammatical equivalents as used herein can refer to a process of altering a gene, e.g., by deletion, insertion, mutation, rearrangement, or any combination thereof. For example, a gene can be disrupted by knockout. Disrupting a gene can be partially reducing or completely suppressing expression (e.g., mRNA and/or protein expression) of the gene. Disrupting can also include inhibitory technology, such as shRNA, siRNA, microRNA, dominant negative, or any other means to inhibit functionality or expression of a gene or protein.

The term "gene editing" and its grammatical equivalents as used herein can refer to genetic engineering in which one or more nucleotides are inserted, replaced, or removed from a genome. For example, gene editing can be performed using a nuclease (e.g., a natural-existing nuclease or an artificially engineered nuclease).

The term "transplant rejection" and its grammatical equivalents as used herein can refer to a process or processes by which an immune response of an organ transplant recipient mounts a reaction against the transplanted material (e.g., cells, tissues, and/or organs) sufficient to impair or destroy the function of the transplanted material.

The term "hyperacute rejection" and its grammatical equivalents as used herein can refer to rejection of a transplanted material or tissue occurring or beginning within the first 24 hours after transplantation. For example, hyperacute rejection can encompass but is not limited to "acute humoral rejection" and "antibody-mediated rejection".

The term "negative vaccine", "tolerizing vaccine" and their grammatical equivalents as used herein, can be used interchangeably. A tolerizing vaccine can tolerize a recipient to a graft or contribute to tolerization of the recipient to the graft if used under the cover of appropriate immunotherapy. This can help to prevent transplantation rejection.

The term "recipient", "subject" and their grammatical equivalents as used herein, can be used interchangeably. A recipient or a subject can be a human or non-human animal. A recipient or a subject can be a human or non-human animal that will receive, is receiving, or has received a transplant graft, a tolerizing vaccine, and/or other composition disclosed in the application. A recipient or subject can also be in need of a transplant graft, a tolerizing vaccine and/or other composition disclosed in the application. In some cases, a recipient can be a human or non-human animal that will receive, is receiving, or has received a transplant graft.

Some numerical values disclosed throughout are referred to as, for example, "X is at least or at least about 100; or 200 [or any numerical number]." This numerical value includes the number itself and all of the following:

i) X is at least 100;
ii) X is at least 200;
iii) X is at least about 100; and
iv) X is at least about 200.

All these different combinations are contemplated by the numerical values disclosed throughout. All disclosed numerical values should be interpreted in this manner, whether it refers to an administration of a therapeutic agent or referring to days, months, years, weight, dosage amounts, etc., unless otherwise specifically indicated to the contrary.

The ranges disclosed throughout are sometimes referred to as, for example, "X is administered on or on about day 1 to 2; or 2 to 3 [or any numerical range]." This range includes the numbers themselves (e.g., the endpoints of the range) and all of the following:

i) X being administered on between day 1 and day 2;
ii) X being administered on between day 2 and day 3;
iii) X being administered on between about day 1 and day 2;
iv) X being administered on between about day 2 and day 3;
v) X being administered on between day 1 and about day 2;
vi) X being administered on between day 2 and about day 3;
vii) X being administered on between about day 1 and about day 2; and
viii) X being administered on between about day 2 and about day 3.

All these different combinations are contemplated by the ranges disclosed throughout. All disclosed ranges should be interpreted in this manner, whether it refers to an administration of a therapeutic agent or referring to days, months, years, weight, dosage amounts, etc., unless otherwise specifically indicated to the contrary.

The terms "and/or" and "any combination thereof" and their grammatical equivalents as used herein, can be used interchangeably. These terms can convey that any combination is specifically contemplated. Solely for illustrative purposes, the following phrases "A, B, and/or C" or "A, B, C, or any combination thereof" can mean "A individually; B individually; C individually; A and B; B and C; A and C; and A, B, and C."

I. Genetically Modified Non-Human Animals

Provided herein are genetically modified animals that can be donors of cells, tissues, and/or organs for transplantation. A genetically modified non-human animal can be any desired species. For example, a genetically modified non-human animal described herein can be a genetically modified non-human mammal. A genetically modified non-human mammal can be a genetically modified ungulate, including a genetically modified even-toed ungulate (e.g., pigs, peccaries, hippopotamuses, camels, llamas, chevrotains (mouse deer), deer, giraffes, pronghorn, antelopes, goat-antelopes (which include sheep, goats and others), or cattle) or a genetically modified odd-toed ungulate (e.g., horse, tapirs, and rhinoceroses), a genetically modified non-human primate (e.g., a monkey, or a chimpanzee) or a genetically modified Canidae (e.g., a dog). A genetically modified non-human animal can be a member of the Laurasiatheria superorder. A genetically modified non-human animal can be a non-human primate, e.g., a monkey, or a chimpanzee. If a non-human animal is a pig, the pig can be at least or at least about 5, 50, 100, or 300 pounds, e.g., the pig can be or be about between 5 pounds to 50 pounds; 25 pounds to 100 pounds; or 75 pounds to 300 pounds. In some cases, a non-human animal is a pig that has given birth at least one time.

A genetically modified non-human animal can be of any age. For example, the genetically modified non-human animal can be a fetus; from or from about 1 day to 1 month; from or from about 1 month to 3 months; from or from about 3 months to 6 months; from or from about 6 months to 9 months; from or from about 9 months to 1 year; from or from about 1 year to 2 years. A genetically modified non-human animal can be a non-human fetal animal, perinatal non-human animal, neonatal non-human animal, preweaning non-human animal, young adult non-human animal, or an adult non-human animal.

A genetically modified non-human animal can comprise reduced expression of one or more genes compared to a non-genetically modified counterpart animal. A non-genetically modified counterpart animal can be an animal substantially identical to the genetically modified animal but without genetic modification in the genome. For example, a non-genetically modified counterpart animal can be a wild-type animal of the same species as the genetically modified animal. The non-human animal can provide cells, tissues or organs for transplanting to a recipient or subject in need thereof. A recipient or subject in need thereof can be a recipient or subject known or suspected of having a condition. The condition can be treated, prevented, reduced, eliminated, or augmented by the methods and compositions disclosed herein. The recipient can exhibit low or no immuno-response to the transplanted cells, tissues or organs. The transplanted cells, tissues or organs can be non-recognizable by CD8+ T cells, NK cells, or CD4+ T cells of the recipient (e.g., a human or another animal). The genes whose expression is reduced can include MHC molecules, regulators of MHC molecule expression, and genes differentially expressed between the donor non-human animal and the recipient (e.g., a human or another animal). The reduced expression can be mRNA expression or protein expression of the one or more genes. For example, the reduced expression can be protein expression of the one or more genes. Reduced expression can also include no expression. For example an animal, cell, tissue or organ with reduced expression of a gene can have no expression (e.g., mRNA and/or protein expression) of the gene. Reduction of expression of a gene can inactivate the function of the gene. In some cases, when expression of a gene is reduced in a genetically modified animal, the expression of the gene is absent in the genetically modified animal.

The genetically modified non-human animal can comprise reduced expression of one or more MHC molecules compared to a non-genetically modified counterpart animal. For example, the non-human animal can be an ungulate, e.g., a pig, with reduced expression of one or more swine leukocyte antigen (SLA) class I and/or SLA class II molecules.

The genetically modified non-human animal can comprise reduced expression of any genes that regulate major histocompatibility complex (MHC) molecules (e.g., MHC I molecules and/or MHC II molecules) compared to a non-genetically modified counterpart animal. Reducing expression of such genes can result in reduced expression and/or function of MHC molecules (e.g., MHC I molecules and/or MHC II molecules). In some cases, the one or more genes whose expression is reduced in the non-human animal can comprise one or more of the following: components of an MHC I-specific enhanceosome, transporters of a MHC I-binding peptide, natural killer group 2D ligands, CXC chemical receptor (CXCR) 3 ligands, complement component 3 (C3), and major histocompatibility complex II transactivator (CIITA). In some cases, the component of a MHC I-specific enhanceosome can be NLRC5. In some cases, the component of a MHC I-specific enhanceosome can also comprise regulatory factor X (RFX) (e.g., RFX1), nuclear transcription factor Y (NFY), and cAMP response element-binding protein (CREB). In some instances, the transporter of a MHC I-binding peptide can be Transporter associated with antigen processing 1 (TAP1). In some cases, the natural killer (NK) group 2D ligands can comprise MICA and MICB. For example, the genetically modified non-human animal can comprise reduced expression of one or more of the following genes: NOD-like receptor family CARD domain containing 5 (NLRC5), Transporter associated with antigen processing 1 (TAP1), C-X-C motif chemokine 10 (CXCL10), MHC class I polypeptide-related sequence A (MICA), MHC class I polypeptide-related sequence B (MICB), complement component 3 (C3), and CIITA. A genetically modified animal can comprise reduced expression of one or more of the following genes: a component of an MHC I-specific enhanceosome (e.g., NLRC5), a transporter of an MHC I-binding peptide (TAP1), and C3.

The genetically modified non-human animal can comprise reduced expression compared to a non-genetically modified counterpart of one or more genes expressed at different levels between the non-human animal and a recipient receiving a cell, tissue, or organ from the non-human animal. For example, the one or more genes can be expressed at a lower level in a human than in the non-human animal. In some cases, the one or more genes can be endogenous genes of the non-human animal. The endogenous genes are in some cases genes not expressed in another species. For example, the endogenous genes of the non-human animal can be genes that are not expressed in a human. For example, in some cases, homologs (e.g., orthologs) of the one or more genes do not exist in a human. In another example, homologs (e.g., orthologs) of the one or more genes can exist in a human but are not expressed.

In some cases, the non-human animal can be a pig, and the recipient can be a human. In these cases, the one or more genes can be any genes expressed in a pig but not in a human. For example, the one or more genes can comprise glycoprotein galactosyltransferase alpha 1,3 (GGTA1), putative cytidine monophosphate-N-acetylneuraminic acid hydroxylase-like protein (CMAH), and β1,4 N-acetylgalactosaminyltransferase (B4GALNT2). A genetically modified non-human animal can comprise reduced expression of B4GALNT2, GGTA1, or CMAH, where the reduced expression is in comparison to a non-genetically modified counterpart animal. A genetically modified non-human animal can comprise reduced expression of B4GALNT2 and GGTA1, where the reduced expression is in comparison to a non-genetically modified counterpart animal. A genetically modified non-human animal can comprise reduced expression of B4GALNT2 and CMAH, where the reduced expression is in comparison to a non-genetically modified counterpart animal. A genetically modified non-human animal can comprise reduced expression of B4GALNT2, GGTA1, and CMAH, where the reduced expression is in comparison to a non-genetically modified counterpart animal.

The genetically modified non-human animal can comprise reduced expression compared to a non-genetically modified counterpart of one or more of any of the genes disclosed herein, including NLRC5, TAP1, CXCL10, MICA, MICB, C3, CIITA, GGTA1, CMAH, and B4GALNT2.

A genetically modified non-human animal can comprise one or more genes whose expression is reduced, e.g., where genetic expression is reduced. The one or more genes whose expression is reduced include but are not limited to NOD-like receptor family CARD domain containing 5 (NLRC5), Transporter associated with antigen processing 1 (TAP1), Glycoprotein galactosyltransferase alpha 1,3 (GGTA1), Putative cytidine monophosphate-N-acetylneuraminic acid hydroxylase-like protein (CMAH), C-X-C motif chemokine 10 (CXCL10), MHC class I polypeptide-related sequence A (MICA), MEW class I polypeptide-related sequence B (MICB), class II major histocompatibility complex transactivator (CIITA), Beta-1,4-N-Acetyl-Galactosaminyl Transferase 2 (B4GALNT2), complemental component 3 (C3), and/or any combination thereof.

A genetically modified non-human animal can comprise 1, 2, 3, 4, 5, 6, 7, 8, 9, 10, 11, 12, 13, 14, 15, 16, 17, 18, 19, 20 or more genes whose expression is disrupted. For illustrative purposes, and not to limit various combinations a person of skill in the art can envision, a genetically modified non-human animal can have NLRC5 and TAP1 individually disrupted. A genetically modified non-human animal can also have both NLRC5 and TAP1 disrupted. A genetically modified non-human animal can also have NLRC5 and TAP1, and in addition to one or more of the following GGTA1, CMAH, CXCL10, MICA, MICB, B4GALNT2, or CIITA genes disrupted; for example "NLRC5, TAP1, and GGTA1" or "NLRC5, TAP1, and CMAH" can be disrupted. A genetically modified non-human animal can also have NLRC5, TAP1, GGTA1, and CMAH disrupted. Alternatively, a genetically modified non-human animal can also have NLRC5, TAP1, GGTA1, B4GALNT2, and CMAH disrupted. In some cases, a genetically modified non-human animal can have C3 and GGTA1 disrupted. In some cases, a genetically modified non-human animal can have reduced expression of NLRC5, C3, GGTA1, B4GALNT2, CMAH, and CXCL10. In some cases, a genetically modified non-human animal can have reduced expression of TAP1, C3, GGTA1, B4GALNT2, CMAH, and CXCL10. In some cases, a genetically modified non-human animal can have reduced expression of NLRC5, TAP1, C3, GGTA1, B4GALNT2, CMAH, and CXCL10.

Lack of MHC class I expression on transplanted human cells can cause the passive activation of natural killer (NK) cells (Ohlen et al., 1989). Lack of MEW class I expression could be due to NLRC5, TAP1, or B2M gene deletion. NK cell cytotoxicity can be overcome by the expression of the human MEW class 1 gene, HLA-E, can stimulate the inhibitory receptor CD94/NKG2A on NK cells to prevent cell killing (Weiss et al., 2009; Lilienfeld et al., 2007; Sasaki et al., 1999). Successful expression of the HLA-E gene can be dependent on co-expression of the human B2M (beta 2 microglobulin) gene and a cognate peptide (Weiss et al., 2009; Lilienfeld et al., 2007; Sasaki et al., 1999; Pascasova et al., 1999). A nuclease mediated break in the stem cell DNA can allow for the insertion of one or multiple genes via homology directed repair. The HLA-E and hB2M genes in series can be integrated in the region of the nuclease mediated DNA break thus preventing expression of the target gene (for example, NLRC5) while inserting the transgenes.

Expression levels of genes can be reduced to various extents. For example, expression of one or more genes can be reduced by or by about 100%. In some cases, expression of one or more genes can be reduced by or by about 99%, 95%, 90%, 85%, 80%, 75%, 70%, 65%, 60%, 55%, or 50% of normal expression, e.g., compared to the expression of non-modified controls. In some cases, expression of one or more genes can be reduced by at least or to at least about 99% to 90%; 89% to 80%, 79% to 70%; 69% to 60%; 59% to 50% of normal expression, e.g., compared to the expression of non-modified controls. For example, expression of one or more genes can be reduced by at least or at least about 90% or by at least or at least about 90% to 99% of normal expression.

Expression can be measured by any known method, such as quantitative PCR (qPCR), including but not limited to PCR, real-time PCR (e.g., Sybr-green), and/or hot PCR. In some cases, expression of one or more genes can be measured by detecting the level of transcripts of the genes. For example, expression of one or more genes can be measured by Northern blotting, nuclease protection assays (e.g., RNase protection assays), reverse transcription PCR, quantitative PCR (e.g., real-time PCR such as real-time quantitative reverse transcription PCR), in situ hybridization (e.g., fluorescent in situ hybridization (FISH)), dot-blot analysis, differential display, serial analysis of gene expression, subtractive hybridization, microarrays, nanostring, and/or sequencing (e.g., next-generation sequencing). In some cases, expression of one or more genes can be measured by detecting the level of proteins encoded by the genes. For example, expression of one or more genes can be measured by protein immunostaining, protein immunoprecipitation, electrophoresis (e.g., SDS-PAGE), Western blotting, bicinchoninic acid assay, spectrophotometry, mass spectrometry, enzyme assays (e.g., enzyme-linked immunosorbent assays), immunohistochemistry, flow cytometry, and/or immunoctyochemistry. Expression of one or more genes can also be measured by microscopy. The microscopy can be optical, electron, or scanning probe microscopy. Optical microscopy can comprise use of bright field, oblique illumination, cross-polarized light, dispersion staining, dark field, phase contrast, differential interference contrast, interference reflection microscopy, fluorescence (e.g., when particles, e.g., cells, are immunostained), confocal, single plane illumination microscopy, light sheet fluorescence microscopy, deconvolution, or serial time-encoded amplified microscopy. Expression of MHC I molecules can also be detected by any methods for testing expression as described herein.

Disrupted Genes

The inventors have found that cells, organs, and/or tissues having different combinations of disrupted genes, can result in cells, organs, and/or tissues that are less susceptible to rejection when transplanted into a recipient. For example, the inventors have found that disrupting (e.g., reducing expression of) certain genes, such as NLRC5, TAP1, GGTA1, B4GALNT2, CMAH, CXCL10, MICA, MICB, C3, and/or CIITA, can increase the likelihood of graft survival.

However, the disruptions are not limited to solely these genes. The disruption can be of any particular gene. It is contemplated that genetic homologues (e.g., any mammalian version of the gene) of the genes within this applications are covered. For example, genes that are disrupted can exhibit a certain identity and/or homology to genes disclosed herein, e.g., NLRC5, TAP1, GGTA1, B4GALNT2, CMAH, CXCL10, MICA, MICB, C3, and/or CIITA. Therefore, it is contemplated that a gene that exhibits at least or at least about 50%, 55%, 60%, 65%, 70%, 75%, 80%, 85%, 90%, 95%, 99%, or 100% homology (at the nucleic acid or protein level) can be disrupted, e.g., a gene that exhibits at least or at least about from 50% to 60%; 60% to 70%; 70% to 80%; 80% to 90%; or 90% to 99% homology. It is also contemplated that a gene that exhibits at least or at least about 50%, 55%, 60%, 65%, 70%, 75%, 80%, 85%, 90%, 99%, or 100% identity (at the nucleic acid or protein level) can be disrupted, e.g., a gene that exhibits at least or at least about from 50% to 60%; 60% to 70%; 70% to 80%; 80% to 90%; or 90% to 99% identity. Some genetic homologues are known in the art, however, in some cases, homologues are unknown. However, homologous genes between mammals can be found by comparing nucleic acid (DNA or RNA) sequences or protein sequences using publically available databases such as NCBI BLAST. Genomic sequences, cDNA and protein sequences of exemplary genes are shown in Table 1.

Gene suppression can also be done in a number of ways. For example, gene expression can be reduced by knock out, altering a promoter of a gene, and/or by administering interfering RNAs (knockdown). This can be done at an organism level or at a tissue, organ, and/or cellular level. If one or more genes are knocked down in a non-human animal, cell, tissue, and/or organ, the one or more genes can be reduced by administrating RNA interfering reagents, e.g., siRNA, shRNA, or microRNA. For example, a nucleic acid which can express shRNA can be stably transfected into a cell to knockdown expression. Furthermore, a nucleic acid which can express shRNA can be inserted into the genome of a non-human animal, thus knocking down a gene with in a non-human animal.

Disruption methods can also comprise overexpressing a dominant negative protein. This method can result in overall decreased function of a functional wild-type gene. Additionally, expressing a dominant negative gene can result in a phenotype that is similar to that of a knockout and/or knockdown.

Sometimes a stop codon can be inserted or created (e.g., by nucleotide replacement), in one or more genes, which can result in a nonfunctional transcript or protein (sometimes referred to as knockout). For example, if a stop codon is created within the middle of one or more genes, the resulting transcription and/or protein can be truncated, and can be nonfunctional. However, in some cases, truncation can lead to an active (a partially or overly active) protein. In some cases, if a protein is overly active, this can result in a dominant negative protein, e.g., a mutant polypeptide that disrupts the activity of the wild-type protein.

This dominant negative protein can be expressed in a nucleic acid within the control of any promoter. For example, a promoter can be a ubiquitous promoter. A promoter can also be an inducible promoter, tissue specific promoter, and/or developmental specific promoter.

The nucleic acid that codes for a dominant negative protein can then be inserted into a cell or non-human animal. Any known method can be used. For example, stable transfection can be used. Additionally, a nucleic acid that codes for a dominant negative protein can be inserted into a genome of a non-human animal.

One or more genes in a non-human animal can be knocked out using any method known in the art. For example, knocking out one or more genes can comprise deleting one or more genes from a genome of a non-human animal. Knocking out can also comprise removing all or a part of a gene sequence from a non-human animal. It is also contemplated that knocking out can comprise replacing all or a part of a gene in a genome of a non-human animal with one or more nucleotides. Knocking out one or more genes can also comprise inserting a sequence in one or more genes thereby disrupting expression of the one or more genes. For example, inserting a sequence can generate a stop codon in the middle of one or more genes. Inserting a sequence can also shift the open reading frame of one or more genes.

Knockout can be done in any cell, organ, and/or tissue in a non-human animal. For example, knockout can be whole body knockout, e.g., expression of one or more genes is reduced in all cells of a non-human animal. Knockout can also be specific to one or more cells, tissues, and/or organs of a non-human animal. This can be achieved by conditional knockout, where expression of one or more genes is selectively reduced in one or more organs, tissues or types of cells. Conditional knockout can be performed by a Cre-lox system, where cre is expressed under the control of a cell, tissue, and/or organ specific promoter. For example, one or more genes can be knocked out (or expression can be reduced) in one or more tissues, or organs, where the one or more tissues or organs can include brain, lung, liver, heart, spleen, pancreas, small intestine, large intestine, skeletal muscle, smooth muscle, skin, bones, adipose tissues, hairs, thyroid, trachea, gall bladder, kidney, ureter, bladder, aorta, vein, esophagus, diaphragm, stomach, rectum, adrenal glands, bronchi, ears, eyes, retina, genitals, hypothalamus, larynx, nose, tongue, spinal cord, or ureters, uterus, ovary, testis, and/or any combination thereof. One or more genes can also be knocked out (or expression can be reduced) in one types of cells, where one or more types of cells include trichocytes, keratinocytes, gonadotropes, corticotropes, thyrotropes, somatotropes, lactotrophs, chromaffin cells, parafollicular cells, *glomus* cells melanocytes, nevus cells, merkel cells, odontoblasts, cementoblasts corneal keratocytes, retina muller cells, retinal pigment epithelium cells, neurons, glias (e.g., oligodendrocyte astrocytes), ependymocytes, pinealocytes, pneumocytes (e.g., type I pneumocytes, and type II pneumocytes), clara cells, goblet cells, G cells, D cells, Enterochromaffin-like cells, gastric chief cells, parietal cells, foveolar cells, K cells, D cells, I cells, goblet cells, paneth cells, enterocytes, microfold cells, hepatocytes, hepatic stellate cells (e.g., Kupffer cells from mesoderm), cholecystocytes, centroacinar cells, pancreatic stellate cells, pancreatic α cells, pancreatic β cells, pancreatic δ cells, pancreatic F cells, pancreatic ε cells, thyroid (e.g., follicular cells), parathyroid (e.g., parathyroid chief cells), oxyphil cells, urothelial cells, osteoblasts, osteocytes, chondroblasts, chondrocytes, fibroblasts, fibrocytes, myoblasts, myocytes, myosatellite cells, tendon cells, cardiac muscle cells, lipoblasts, adipocytes, interstitial cells of cajal, angioblasts, endothelial cells, mesangial cells (e.g., intraglomerular mesangial cells and extraglomerular mesangial cells), juxtaglomerular cells, macula *densa* cells, stromal cells, interstitial cells, telocytes simple epithelial cells, podocytes, kidney proximal tubule brush border cells, sertoli cells, leydig cells, granulosa cells, peg cells, germ cells, spermatozoon ovums, lymphocytes, myeloid cells, endothelial progenitor cells, endothelial stem cells, angioblasts, mesoangioblasts, pericyte mural cells, and/or any combination thereof.

Conditional knockouts can be inducible, for example, by using tetracycline inducible promoters, development specific promoters. This can allow for eliminating or suppressing expression of a gene/protein at any time or at a specific time. For example, with the case of a tetracycline inducible promoter, tetracycline can be given to a non-human animal any time after birth. If a non-human animal is a being that develops in a womb, then promoter can be induced by giving tetracycline to the mother during pregnancy. If a non-human animal develops in an egg, a promoter can be induced by injecting, or incubating in tetracycline. Once tetracycline is given to a non-human animal, the tetracycline will result in expression of cre, which will then result in excision of a gene of interest.

A cre/lox system can also be under the control of a developmental specific promoter. For example, some promoters are turned on after birth, or even after the onset of puberty. These promoters can be used to control cre expression, and therefore can be used in developmental specific knockouts.

It is also contemplated that any combinations of knockout technology can be combined. For example, tissue specific knockout can be combined with inducible technology, creating a tissue specific, inducible knockout. Furthermore, other systems such developmental specific promoter, can be used in combination with tissues specific promoters, and/or inducible knockouts.

Knocking out technology can also comprise gene editing. For example, gene editing can be performed using a nuclease, including CRISPR associated proteins (Cas proteins, e.g., Cas9), Zinc finger nuclease (ZFN), Transcription Activator-Like Effector Nuclease (TALEN), and maganucleases. Nucleases can be naturally existing nucleases, genetically modified, and/or recombinant. For example, a CRISPR/cas system can be suitable as a gene editing system.

It is also contemplated that less than all alleles of one or more genes of a non-human animal can be knocked out. For example, in diploid non-human animals, it is contemplated that one of two alleles are knocked out. This can result in decreased expression and decreased protein levels of genes. Overall decreased expression can be less than or less than about 99%, 95%, 90%, 85%, 80%, 75%, 70%, 65%, 60%, 55%, 50%, 45%, 40%, 35%, 30%, 25%, or 20%; e.g., from or from about 99% to 90%; 90% to 80%; 80% to 70%; 70% to 60%; 60% to 50%; 50% to 40%; 40% to 30%, or 30% to 20%; compared to when both alleles are functioning, for example, not knocked out and/or knocked down. Additionally, overall decrease in protein level can be the same as the decreased in overall expression. Overall decrease in protein level can be about or less than about 99%, 95%, 90%, 80%, 70%, 60%, 50%, 40%, 30%, or 20%, e.g., from or from about 99% to 90%; 90% to 80%; 80% to 70%; 70% to 60%; 60% to 50%; 50% to 40%; 40% to 30%, or 30% to 20%; compared to when both alleles are functioning, for example, not knocked out and/or knocked down. However, it is also contemplated that all alleles of one or more genes in a non-human animal can be knocked out.

Knocking out of one or more genes can be validated by genotyping. Methods for genotyping can include sequencing, restriction fragment length polymorphism identification (RFLPI), random amplified polymorphic detection (RAPD), amplified fragment length polymorphism detection (AFLPD), PCR (e.g., long range PCR, or stepwise PCR), allele specific oligonucleotide (ASO) probes, and hybridization to DNA microarrays or beads. For example, genotyping can be performed by sequencing. In some cases, sequencing can be high fidelity sequencing. Methods of sequencing can include Maxam-Gilbert sequencing, chain-termination methods (e.g., Sanger sequencing), shotgun sequencing, and bridge PCR. In some cases, genotyping can be performed by next-generation sequencing. Methods of next-generation sequencing can include massively parallel signature sequencing, polony sequencing, pyrosequencing (e.g., pyrosequencing developed by 454 Life Sciences), single-molecule rea-time sequencing (e.g., by Pacific Biosciences), Ion semiconductor sequencing (e.g., by Ion Torrent semiconductor sequencing), sequencing by synthesis (e.g., by Solexa sequencing by Illumina), sequencing by ligation (e.g., SOLiD sequencing by Applied Biosystems), DNA nanoball sequencing, and heliscope single molecule sequencing. In some cases, genotyping of a non-human animal herein can comprise full genome sequencing analysis. In some cases, knocking out of a gene in an animal can be validated by sequencing (e.g., next-generation sequencing) a part of the gene or the entire gene. For example, knocking out of NLRC5 gene in a pig can be validated by next generation sequencing of the entire NLRC5. The next generation sequencing of NLRC5 can be performed using e.g. using forward primer 5'-gctgtggcatatggcagttc-3' (SEQ ID No. 1) and reverse primer 5'-tccatgtataagtcttta-3' (SEQ ID No. 2), or forward primer 5'-ggcaatgccagatcctcaac-3' (SEQ ID No. 3) and reverse primer 5'-tgtctgatgtctttctcatg-3' (SEQ ID No. 4).

TABLE 1

Genomic sequences, cDNA and proteins of exemplary disrupted genes

| Gene | Genomic sequence SEQ ID No. | cDNA SEQ ID No. | cDNA Accession No. | protein SEQ ID No. | protein Accession No. |
|---|---|---|---|---|---|
| NLRC5 | 5 | 6 | KC514136.1 | 7 | AGG68119.1 |
| TAP1 | 8 | 9 | NM_001044581 | 10 | NP_001038046.1 |
| GGTA1 | 11 | 12 | AF221508 | 13 | NP_998975.1 |
| CMAH | 14 | 15 | NM_001113015 | 16 | NP_001106486.1 |
| CXCL10 | 17 | 18 | NM_001008691.1 | 19 | NP_001008691.1 |
| CIITA | 20 | 21 | XM_013995652.1 | 22 | XP_013851106.1 |
| B4GALNT2 | 23 | 24 | NM_001244330.1 | 25 | NP_001231259.1 |
| C3 | 26 | 27 | NM_214009.1 | 28 | NP_999174.1 |
| MICA | 29 | 30 | NM_000247.2 | 31 | NP_000238.1 |
| MICB | 32 | 33 | NM_001289160.1 | 34 | NP_001276089.1 |

Transgenes

Transgenes can be useful for overexpressing endogenous genes at higher levels than without the transgenes. Additionally, transgenes can be used to express exogenous genes. Transgenes can also encompass other types of genes, for example, a dominant negative gene.

A transgene of protein X can refer to a transgene comprising a nucleotide sequence encoding protein X. As used herein, in some cases, a transgene encoding protein X can be a transgene encoding 100% or about 100% of the amino acid sequence of protein X. In some cases, a transgene encoding protein X can encode the full or partial amino sequence of protein X. For example, the transgene can encode at least or at least about 99%, 95%, 90%, 80%, 70%, 60%, 50%, 40%, 30%, 20%, 10%, or 5%, e.g., from or from about 99% to 90%; 90% to 80%; 80% to 70%; 70% to 60%; or 60% to 50%; of the amino acid sequence of protein X. Expression of a transgene can ultimately result in a functional protein, e.g., a partially or fully functional protein. As discussed above, if a partial sequence is expressed, the ultimate result can be in some cases a nonfunctional protein or a dominant negative protein. A nonfunctional protein or dominant negative protein can also compete with a functional (endogenous or exogenous) protein. A transgene can also encode an RNA (e.g., mRNA, shRNA, siRNA, or microRNA). In some cases, where a transgene encodes for an mRNA, this can in turn be translated into a polypeptide (e.g., a protein). Therefore, it is contemplated that a transgene can encode for protein. A transgene can, in some instances, encode a protein or a portion of a protein. Additionally, a protein can have one or more mutations (e.g., deletion, insertion, amino acid replacement, or rearrangement) compared to a wild-type polypeptide. A protein can be a natural polypeptide or an artificial polypeptide (e.g., a recombinant polypeptide). A transgene can encode a fusion protein formed by two or more polypeptides.

Transgenes can be placed into an organism, cell, tissue, or organ, in a manner which produces a product of the transgene. For example, disclosed herein is a non-human animal comprising one or more transgenes. One or more transgenes can be in combination with one or more disruptions as described herein. A transgene can be incorporated into a cell. For example, a transgene can be incorporated into an organism's germ line. When inserted into a cell, a transgene can be either a complementary DNA (cDNA) segment, which is a copy of messenger RNA (mRNA), or a gene itself residing in its original region of genomic DNA (with or without introns).

Figure 14A:
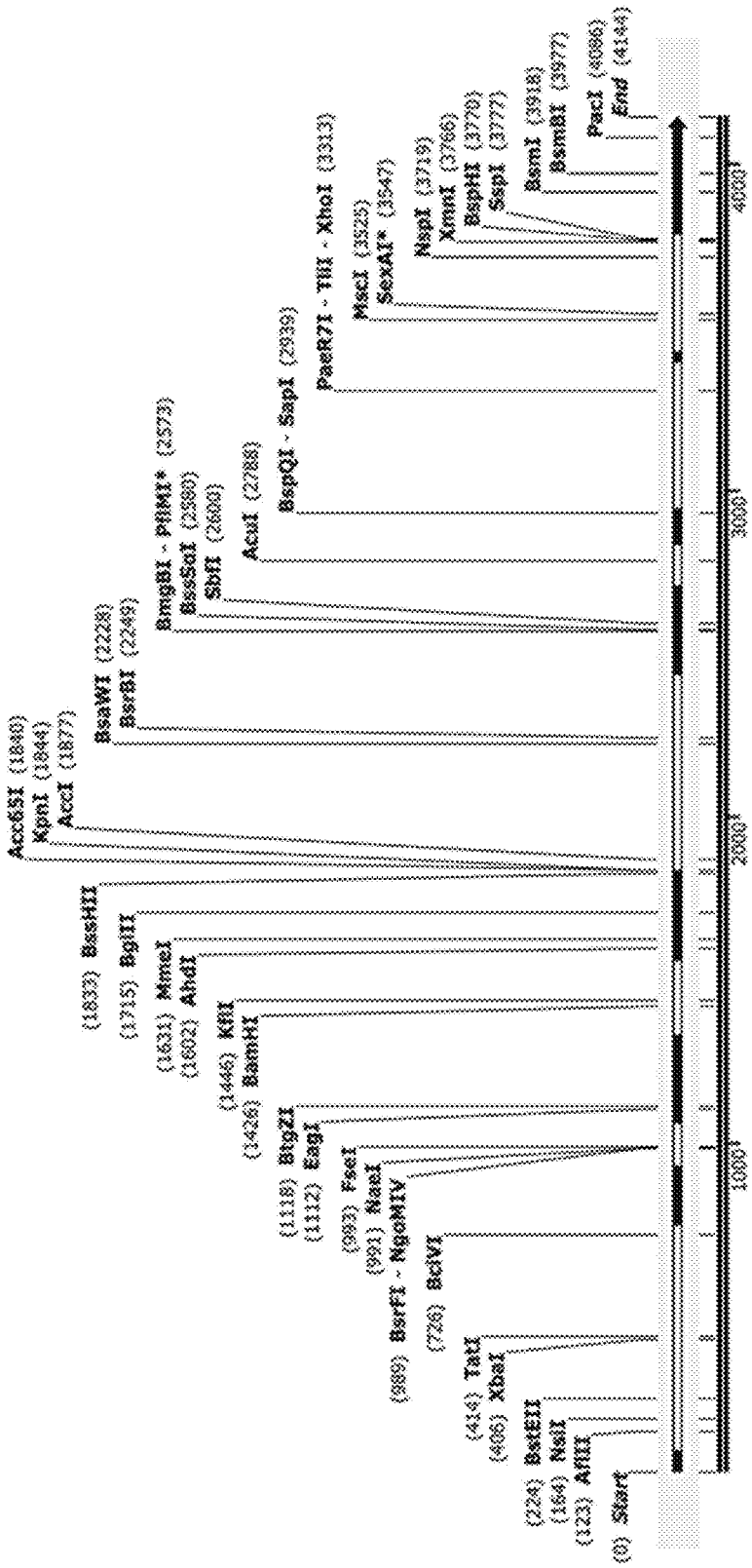
FIG. 14A shows a map of the genomic sequence of GGTA1.
Figure 14B:
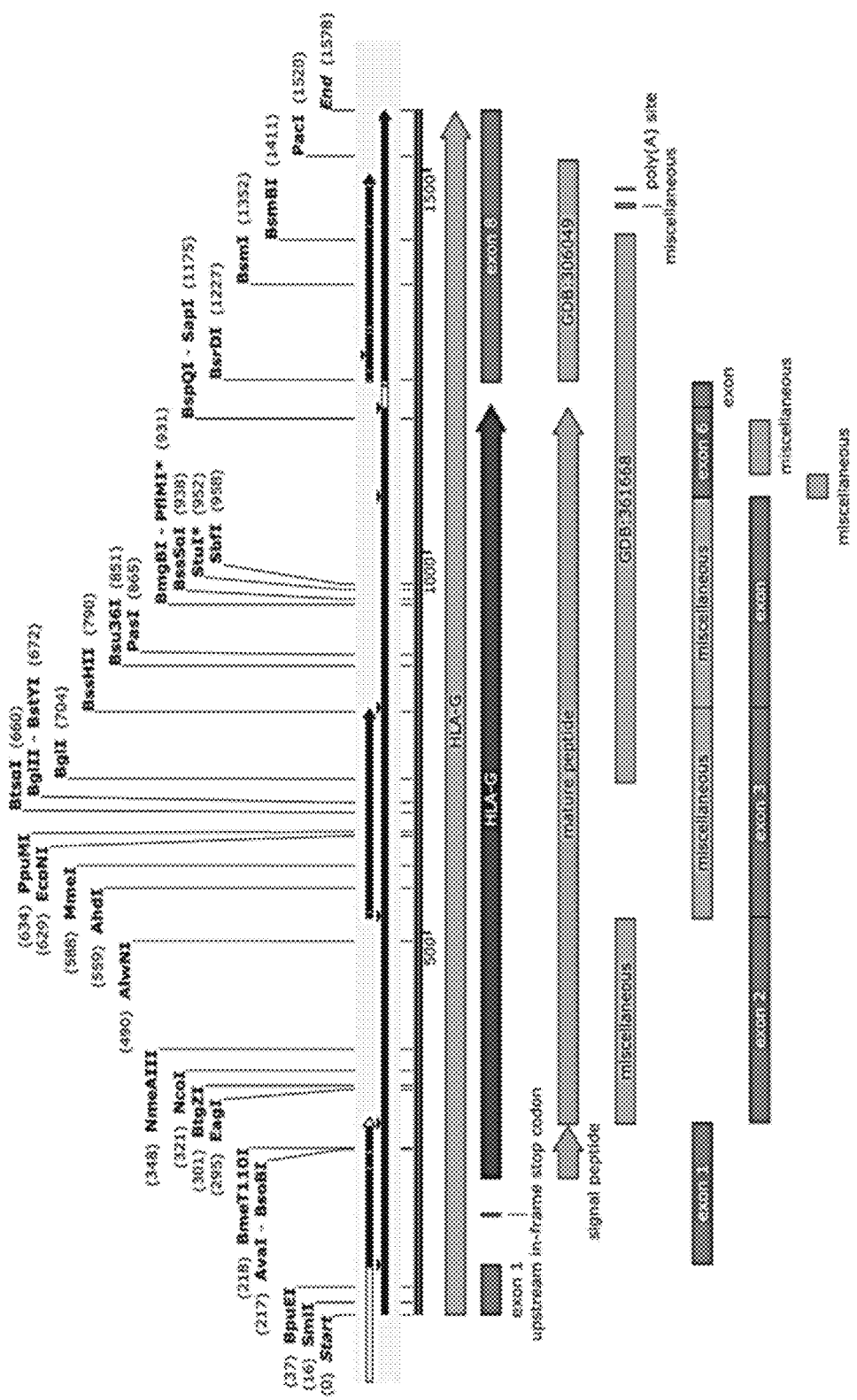
FIG. 14B shows a map of the cDNA sequence of GGTA1.

A non-human animal can comprise one or more transgenes comprising one or more polynucleotide inserts. The polynucleotide inserts can encode one or proteins or functional fragments thereof. In some cases, a non-human animal can comprise one or more transgenes comprising one or more polynucleotide inserts encoding proteins that can reduce expression and/or function of MHC molecules (e.g., MHC I molecules and/or MHC II molecules). The one or more transgenes can comprise one or more polynucleotide inserts encoding MHC I formation suppressors, regulators of complement activations, inhibitory ligands for NK cells, B7 family members, CD47, serine protease inhibitors, galectins, and/or any fragments thereof. In some cases, the MHC I formation suppressors can be infected cell protein 47 (ICP47). In some cases, regulators of complement activation can comprise cluster of differentiation 46 (CD46), cluster of differentiation 55 (CD55), and cluster of differentiation 59 (CD59). In some cases, inhibitory ligands for NK cells can comprise leukocyte antigen E (HLA-E), human leukocyte antigen G (HLA-G), and β-2-microglobulin (B2M). An inhibitory ligand for NK cells can be an isoform of HLA-G, e.g., HLA-G1, HLA-G2, HLA-G3, HLA-G4, HLA-G5, HLA-G6, or HLA-G7. For example, inhibitory ligand for NK cells can be HLA-G1. A transgene of HLA-G (e.g., HLA-G1, HLA-G2, HLA-G3, HLA-G4, HLA-G5, HLA-G6, or HLA-G7) can refer to a transgene comprising a nucleotide sequence encoding HLA-G (e.g., HLA-G1, HLA-G2, HLA-G3, HLA-G4, HLA-G5, HLA-G6, or HLA-G7). As used herein, in some cases, a transgene encoding HLA-G (e.g., HLA-G1, HLA-G2, HLA-G3, HLA-G4, HLA-G5, HLA-G6, or HLA-G7) can be a transgene encoding 100% or about 100% of the amino acid sequence of HLA-G (e.g., HLA-G1, HLA-G2, HLA-G3, HLA-G4, HLA-G5, HLA-G6, or HLA-G7). In other cases, a transgene encoding HLA-G (e.g., HLA-G1, HLA-G2, HLA-G3, HLA-G4, HLA-G5, HLA-G6, or HLA-G7) can be a transgene encoding the full or partial sequence of HLA-G (e.g., HLA-G1, HLA-G2, HLA-G3, HLA-G4, HLA-G5, HLA-G6, or HLA-G7). For example, the transgene can encode at least or at least about 99%, 95%, 90%, 80%, 70%, 60%, or 50% of the amino acid sequence of HLA-G (e.g., HLA-G1, HLA-G2, HLA-G3, HLA-G4, HLA-G5, HLA-G6, or HLA-G7). For example, the transgene can encode 90% of the HLA-G amino acid sequence. A transgene can comprise polynucleotides encoding a functional (e.g., a partially or fully functional) HLA-G (e.g., HLA-G1, HLA-G2, HLA-G3, HLA-G4, HLA-G5, HLA-G6, or HLA-G7). In some cases, the one or more transgenes can comprise one or more polynucleotide inserts encoding one or more of ICP47, CD46, CD55, CD59, HLA-E, HLA-G (e.g., HLA-G1, HLA-G2, HLA-G3, HLA-G4, HLA-G5, HLA-G6, or HLA-G7), and B2M. The HLA-G genomic DNA sequence can have 8 exons by which alternative splicing results in 7 isoforms. The HLA-G1 isoform can exclude exon 7. The HLA-G2 isoform can exclude exon 3 and 7. Translation of intron 2 or intron 4 can result secreted isoforms due to the loss of the transmembrane domain expression. The maps of the genomic sequence and cDNA of HLA-G are shown in FIGS. 14A-14B. In some cases, B7 family members can comprise CD80, CD86, programmed death-ligand 1 (PD-L1), programmed death-ligand 2 (PD-L2), CD275, CD276, V-set domain containing T cell activation inhibitor 1 (VTCN1), platelet receptor Gi24, natural cytotoxicity triggering receptor 3 ligand 1 (NR3L1), and HERV-H LTR-associating 2 (HHLA2). For example, a B7 family member can be PD-L1 or PD-L2. In some cases, a serine protease inhibitor can be serine protease inhibitor 9 (Spi9). In some cases, galectins can comprise galectin-1, galectin-2, galectin-3, galectin-4, galectin-5, galectin-6, galectin-7, galectin-8, galectin-9, galectin-10, galectin-11, galectin-12, galectin-13, galectin-14, and galectin-15. For example, a galectin can be galectin-9.

A genetically modified non-human animal can comprise reduced expression of one or more genes and one or more transgenes disclosed herein. In some cases, a genetically modified non-human animal can comprise reduced expression of one or more of NLRC5, TAP1, CXCL10, MICA, MICB, C3, CIITA, GGTA1, CMAH, and B4GALNT2, and one or more transgenes comprising one or more polynucleotide inserts encoding one or more of ICP47, CD46, CD55, CD59, HLA-E, HLA-G (e.g., HLA-G1, HLA-G2, HLA-G3, HLA-G4, HLA-G5, HLA-G6, or HLA-G7), B2M, PD-L1, PD-L2, CD47, Spi9, and galectin-9. In some cases, a genetically modified non-human animal can comprise reduced expression GGTA1, CMAH, and B4GALNT2, and exogenous polynucleotides encoding HLA-G (e.g., HLA-G1, HLA-G2, HLA-G3, HLA-G4, HLA-G5, HLA-G6, or HLA-G7), CD47 (e.g., human CD47), PD-L1 (e.g., human PD-L1), and PD-L2 (e.g., human PD-L2). In some cases, a genetically modified non-human animal can comprise reduced expression GGTA1, CMAH, and B4GALNT2, and exogenous polynucleotides encoding HLA-E, CD47 (e.g., human CD47), PD-L1 (e.g., human PD-L1), and PD-L2 (e.g., human PD-L2). In some cases, a genetically modified non-human animal can comprise reduced expression NLRC5, C3, CXC10, GGTA1, CMAH, and B4GALNT2, and exogenous polynucleotides encoding HLA-G (e.g., HLA-G1, HLA-G2, HLA-G3, HLA-G4, HLA-G5, HLA-G6, or HLA-G7), CD47 (e.g., human CD47), PD-L1 (e.g., human PD-L1), and PD-L2 (e.g., human PD-L2). In some cases, a genetically modified non-human animal can comprise reduced expression TAP1, C3, CXC10GGTA1, CMAH, and B4GALNT2, and exogenous polynucleotides encoding HLA-G (e.g., HLA-G1, HLA-G2, HLA-G3, HLA-G4, HLA-G5, HLA-G6, or HLA-G7), CD47 (e.g., human CD47), PD-L1 (e.g., human PD-L1), and PD-L2 (e.g., human PD-L2). In some cases, a genetically modified non-human animal can comprise reduced expression NLRC5, C3, CXC10, GGTA1, CMAH, and B4GALNT2, and exogenous polynucleotides encoding HLA-E, CD47 (e.g., human CD47), PD-L1 (e.g., human PD-L1), and PD-L2 (e.g., human PD-L2). In some cases, a genetically modified non-human animal can comprise reduced expression TAP1, C3, CXC10, GGTA1, CMAH, and B4GALNT2, and exogenous polynucleotides encoding HLA-E. In some cases, a genetically modified non-human animal can comprise reduced expression of GGTA1 and a transgene comprising one or more polynucleotide inserts encoding HLA-E. In some cases, a genetically modified non-human animal can comprise reduced expression of GGTA1 and a transgene comprising one or more polynucleotide inserts encoding HLA-G (e.g., HLA-G1, HLA-G2, HLA-G3, HLA-G4, HLA-G5, HLA-G6, or HLA-G7). In some cases, a genetically modified non-human animal can comprise a transgene comprising one or more polynucleotide inserts encoding HLA-G (e.g., HLA-G1, HLA-G2, HLA-G3, HLA-G4, HLA-G5, HLA-G6, or HLA-G7) inserted adjacent to a Rosa26 promoter, e.g., a porcine Rosa26 promoter. In some cases, a genetically modified non-human animal can comprise reduced expression of NLRC5, C3, GGTA1, CMAH, and B4GALNT2, and transgenes comprising polynucleotides encoding proteins or functional fragments thereof, where the proteins comprise HLA-G1, Spi9, PD-L1, PD-L2, CD47, and galectin-9. In some cases, a genetically modified non-human animal can comprise reduced expression of TAP1, C3, GGTA1, CMAH, and B4GALNT2, and transgenes comprising polynucleotides encoding proteins or functional fragments thereof, where the proteins comprise HLA-G1, Spi9, PD-L1, PD-L2, CD47, and galectin-9. In some cases, a genetically modified non-human animal can comprise reduced expression of NLRC5, TAP1, C3, GGTA1, CMAH, and B4GALNT2, and transgenes comprising polynucleotides encoding proteins or functional fragments thereof, where the proteins comprise HLA-G1, Spi9, PD-L1, PD-L2, CD47, and galectin-9. In some cases, a genetically modified non-human animal can comprise reduced protein expression of NLRC5, C3, GGTA1, and CXCL10, and transgenes comprising polynucleotides encoding proteins or functional fragments thereof, where the protein comprise HLA-G1 or HLA-E. In some cases, a genetically modified non-human animal can comprise reduced protein expression of TAP1, C3, GGTA1, and CXCL10, and transgenes comprising polynucleotides encoding proteins or functional fragments thereof, where the protein comprise HLA-G1 or HLA-E. In some cases, a genetically modified non-human animal can comprise reduced protein expression of NLRC5, TAP1, C3, GGTA1, and CXCL10, and transgenes comprising polynucleotides encoding proteins or functional fragments thereof, where the protein comprise HLA-G1 or HLA-E. In some cases, CD47, PD-L1, and PD-L2 encoded by the transgenes herein can be human CD47, human PD-L1 and human PD-L2.

A genetically modified non-human animal can comprise a transgene inserted in a locus in the genome of the animal. In some cases, a transgene can be inserted adjacent to the promoter of or inside a targeted gene. In some cases, insertion of the transgene can reduce the expression of the targeted gene. The targeted gene can be a gene whose expression is reduced disclosed herein. For example, a transgene can be inserted adjacent to the promoter of or inside one or more of NLRC5, TAP1, CXCL10, MICA, MICB, C3, CIITA, GGTA1, CMAH, and B4GALNT2. In some cases, a transgene can be inserted adjacent to the promoter of or inside GGTA1.

For example, a non-human animal can comprise one or more transgenes comprising one or more polynucleotide inserts of Infected cell protein 47 (ICP47), Cluster of differentiation 46 (CD46), Cluster of differentiation 55 (CD55), Cluster of differentiation 59 (CD 59), HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, galectin-9, any functional fragments thereof, or any combination thereof. Polynucleotide encoding for ICP47, CD46, CD55, CD59, HLA-E, HLA-G (e.g., HLA-G1, HLA-G2, HLA-G3, HLA-G4, HLA-G5, HLA-G6, or HLA-G7), or B2M can encode one or more of ICP47, CD46, CD55, CD59, HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, or galectin-9 human proteins. A non-human animal can comprise 1, 2, 3, 4, 5, 6, 7, 8, 9, 10, 11, 12, 13, 14, 15, 16, 17, 18, 19, 20, or more transgenes. For example, a non-human animal can comprise one or more transgene comprising ICP47, CD46, CD55, CD59, HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, galectin-9, any functional fragments thereof, or any combination thereof. A non-human animal can also comprise a single transgene encoding ICP47. A non-human animal can sometimes comprise a single transgene encoding CD59. A non-human animal can sometimes comprise a single transgene encoding HLA-G (e.g., HLA-G1, HLA-G2, HLA-G3, HLA-G4, HLA-G5, HLA-G6, or HLA-G7). A non-human animal can sometimes comprise a single transgene encoding HLA-E. A non-human animal can sometimes comprise a single transgene encoding B2M. A non-human animal can also comprise two or more transgenes, where the two or more transgenes are ICP47, CD46, CD55, CD59, and/or any combination thereof. For example, two or more transgenes can comprise CD59 and CD46 or CD59 and CD55. A non-human animal can also comprise three or more transgenes, where the three or more transgenes can comprise ICP47, CD46, CD55, CD59, or any combination thereof. For example, three or more transgenes can comprise CD59, CD46, and CD55. A non-human animal can also comprise four or more transgenes, where the four or more transgenes can comprise ICP47, CD46, CD55, and CD59. A non-human animal can comprise four or more transgenes comprising ICP47, CD46, CD55, and CD59.

A combination of transgenes and gene disruptions can be used. A non-human animal can comprise one or more reduced genes and one or more transgenes. For example, one or more genes whose expression is reduced can comprise any one of NLRC5, TAP1, GGTA1, B4GALNT2, CMAH, CXCL10, MICA, MICB, C3, CIITA, and/or any combination thereof, and one or more transgene can comprise ICP47, CD46, CD55, CD 59, any functional fragments thereof, and/or any combination thereof. For example, solely to illustrate various combinations, one or more genes whose expression is disrupted can comprise NLRC5 and one or more transgenes comprise ICP47. One or more genes whose expression is disrupted can also comprise TAP1, and one or more transgenes comprise ICP47. One or more genes whose expression is disrupted can also comprise NLRC5 and TAP1, and one or more transgenes comprise ICP47. One or more genes whose expression is disrupted can also comprise NLRC5, TAP1, and GGTA1, and one or more transgenes comprise ICP47. One or more genes whose expression is disrupted can also comprise NLRC5, TAP1, B4GALNT2, and CMAH, and one or more transgenes comprise ICP47. One or more genes whose expression is disrupted can also comprise NLRC5, TAP1, GGTA1, B4GALNT2, and CMAH, and one or more transgenes comprise ICP47. One or more genes whose expression is disrupted can also comprise NLRC5 and one or more transgenes comprise CD59. One or more genes whose expression is disrupted can also comprise TAP1, and one or more transgenes comprise CD59. One or more genes whose expression is disrupted can also comprise NLRC5 and TAP1, and one or more transgenes comprise CD59. One or more genes whose expression is disrupted can also comprise NLRC5, TAP1, and GGTA1, and one or more transgenes comprise CD59. One or more genes whose expression is disrupted can also comprise NLRC5, TAP1, B4GALNT2, and CMAH, and one or more transgenes comprise CD59. One or more genes whose expression is disrupted can also comprise NLRC5, TAP1, GGTA1, B4GALNT2, and CMAH, and one or more transgenes comprise CD59.

Transgenes that can be used and are specifically contemplated can include those genes that exhibit a certain identity and/or homology to genes disclosed herein, for example, ICP47, CD46, CD55, CD59, HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, galectin-9, any functional fragments thereof, and/or any combination thereof. Therefore, it is contemplated that if gene that exhibits at least or at least about 60%, 70%, 80%, 90%, 95%, 98%, or 99% homology, e.g., at least or at least about 99% to 90%; 90% to 80%; 80% to 70%; 70% to 60% homology; (at the nucleic acid or protein level), it can be used as a transgene. It is also contemplated that a gene that exhibits at least or at least about 60%, 65%, 70%, 75%, 80%, 85%, 90%, 95%, 98%, or 99%, identity e.g., at least or at least about 99% to 90%; 90% to 80%; 80% to 70%; 70% to 60% identity; (at the nucleic acid or protein level) can be used as a transgene.

A non-human animal can also comprise 1, 2, 3, 4, 5, 6, 7, 8, 9, 10, 11, 12, 13, 14, 15, 16, 17, 18, 19, 20, or more dominant negative transgenes. Expression of a dominant negative transgenes can suppress expression and/or function of a wild type counterpart of the dominant negative transgene. Thus, for example, a non-human animal comprising a dominant negative transgene X, can have similar phenotypes compared to a different non-human animal comprising an X gene whose expression is reduced. One or more dominant negative transgenes can be dominant negative NLRC5, dominant negative TAP1, dominant negative GGTA1, dominant negative CMAH, dominant negative B4GALNT2, dominant negative CXCL10, dominant negative MICA, dominant negative MICB, dominant negative CIITA, dominant negative C3, or any combination thereof.

Also provided is a non-human animal comprising one or more transgenes that encodes one or more nucleic acids that can suppress genetic expression, e.g., can knockdown a gene. RNAs that suppress genetic expression can comprise, but are not limited to, shRNA, siRNA, RNAi, and microRNA. For example, siRNA, RNAi, and/or microRNA can be given to a non-human animal to suppress genetic expression. Further, a non-human animal can comprise one or more transgene encoding shRNAs. shRNA can be specific to a particular gene. For example, a shRNA can be specific to any gene described in the application, including but not limited to, NLRC5, TAP1, GGTA1, B4GALNT2, CMAH, CXCL10, MICA, MICB, B4GALNT2, CIITA, C3, and/or any combination thereof.

When transplanted to a subject, cells, tissues, or organs from the genetically modified non-human animal can trigger lower immune responses (e.g., transplant rejection) in the subject compared to cells, tissues, or organs from a non-genetically modified counterpart. In some cases, the immune responses can include the activation, proliferation and cytotoxicity of T cells (e.g., CD8+ T cells and/or CD4+ T cells) and NK cells. Thus, phenotypes of genetically modified cells disclosed herein can be measured by co-culturing the cells with NK cells, T cells (e.g., CD8+ T cells or CD4+ T cells), and testing the activation, proliferation and cytotoxicity of the NK cells or T cells. In some cases, the T cells or NK cells activation, proliferation and cytotoxicity induced by the genetically modified cells can be lower than that induced by non-genetically modified cells. In some cases, phenotypes of genetically modified cells herein can be measured by Enzyme-Linked ImmunoSpot (ELISPOT) assays.

One or more transgenes can be from different species. For example, one or more transgenes can comprise a human gene, a mouse gene, a rat gene, a pig gene, a bovine gene, a dog gene, a cat gene, a monkey gene, a chimpanzee gene, or any combination thereof. For example, a transgene can be from a human, having a human genetic sequence. One or more transgenes can comprise human genes. In some cases, one or more transgenes are not adenoviral genes.

A transgene can be inserted into a genome of a non-human animal in a random or site-specific manner. For example, a transgene can be inserted to a random locus in a genome of a non-human animal. These transgenes can be fully functional if inserted anywhere in a genome. For instance, a transgene can encode its own promoter or can be inserted into a position where it is under the control of an endogenous promoter. Alternatively, a transgene can be inserted into a gene, such as an intron of a gene or an exon of a gene, a promoter, or a non-coding region.

Sometimes, more than one copy of a transgene can be inserted into more than a random locus in a genome. For example, multiple copies can be inserted into a random locus in a genome. This can lead to increased overall expression than if a transgene was randomly inserted once. Alternatively, a copy of a transgene can be inserted into a gene, and another copy of a transgene can be inserted into a different gene. A transgene can be targeted so that it could be inserted to a specific locus in a genome of a non-human animal.

Expression of a transgene can be controlled by one or more promoters. A promoter can be a ubiquitous, tissue-specific promoter or an inducible promoter. Expression of a transgene that is inserted adjacent to a promoter can be regulated. For example, if a transgene is inserted near or next to a ubiquitous promoter, the transgene will be expressed in all cells of a non-human animal. Some ubiquitous promoters can be a CAGGS promoter, an hCMV promoter, a PGK promoter, an SV40 promoter, or a Rosa26 promoter.

A promoter can be endogenous or exogenous. For example, one or more transgenes can be inserted adjacent to an endogenous or exogenous Rosa26 promoter. Further, a promoter can be specific to a non-human animal. For example, one or more transgenes can be inserted adjacent to a porcine Rosa26 promoter.

Tissue specific promoter (which can be synonymous with cell-specific promoters) can be used to control the location of expression. For example, one or more transgenes can be inserted adjacent to a tissue-specific promoter. Tissue-specific promoters can be a FABP promoter, a Lck promoter, a CamKII promoter, a CD19 promoter, a Keratin promoter, an Albumin promoter, an aP2 promoter, an insulin promoter, an MCK promoter, an MyHC promoter, a WAP promoter, or a Col2A promoter. For example, a promoter can be a pancreas-specific promoter, e.g., an insulin promoter.

Inducible promoters can be used as well. These inducible promoters can be turned on and off when desired, by adding or removing an inducing agent. It is contemplated that an inducible promoter can be a Lac, tac, trc, trp, araBAD, phoA, recA, proU, cst-1, tetA, cadA, nar, PL, cspA, T7, VHB, Mx, and/or Trex.

A non-human animal or cells as described herein can comprise a transgene encoding insulin. A transgene encoding insulin can be a human gene, a mouse gene, a rat gene, a pig gene, a cattle gene, a dog gene, a cat gene, a monkey gene, a chimpanzee gene, or any other mammalian gene. For example, a transgene encoding insulin can be a human gene. A transgene encoding insulin can also be a chimeric gene, for example, a partially human gene.

Expression of transgenes can be measured by detecting the level of transcripts of the transgenes. For example, expression of transgenes can be measured by Northern blotting, nuclease protection assays (e.g., RNase protection assays), reverse transcription PCR, quantitative PCR (e.g., real-time PCR such as real-time quantitative reverse transcription PCR), in situ hybridization (e.g., fluorescent in situ hybridization (FISH)), dot-blot analysis, differential display, Serial analysis of gene expression, subtractive hybridization, microarrays, nanostring, and/or sequencing (e.g., next-generation sequencing). In some cases, expression of transgenes can be measured by detecting proteins encoded by the genes. For example, expression of one or more genes can be measured by protein immunostaining, protein immunoprecipitation, electrophoresis (e.g., SDS-PAGE), Western blotting, bicinchoninic acid assay, spectrophotometry, mass spectrometry, enzyme assays (e.g., enzyme-linked immunosorbent assays), immunohistochemistry, flow cytometry, and/or immunocytochemistry. In some cases, expression of transgenes can be measured by microscopy. The microscopy can be optical, electron, or scanning probe microscopy. In some cases, optical microscopy comprises use of bright field, oblique illumination, cross-polarized light, dispersion staining, dark field, phase contrast, differential interference contrast, interference reflection microscopy, fluorescence (e.g., when particles, e.g., cells, are immunostained), confocal, single plane illumination microscopy, light sheet fluorescence microscopy, deconvolution, or serial time-encoded amplified microscopy.

Insertion of transgenes can be validated by genotyping. Methods for genotyping can include sequencing, restriction fragment length polymorphism identification (RFLPI), random amplified polymorphic detection (RAPD), amplified fragment length polymorphism detection (AFLPD), PCR (e.g., long range PCR, or stepwise PCR), allele specific oligonucleotide (ASO) probes, and hybridization to DNA microarrays or beads. In some cases, genotyping can be performed by sequencing. In some cases, sequencing can be high fidelity sequencing. Methods of sequencing can include Maxam-Gilbert sequencing, chain-termination methods (e.g., Sanger sequencing), shotgun sequencing, and bridge PCR. In some cases, genotyping can be performed by next-generation sequencing. Methods of next-generation sequencing can include massively parallel signature sequencing, polony sequencing, pyrosequencing (e.g., pyrosequencing developed by 454 Life Sciences), single-molecule rea-time sequencing (e.g., by Pacific Biosciences), Ion semiconductor sequencing (e.g., by Ion Torrent semiconductor sequencing), sequencing by synthesis (e.g., by Solexa sequencing by Illumina), sequencing by ligation (e.g., SOLiD sequencing by Applied Biosystems), DNA nanoball sequencing, and heliscope single molecule sequencing. In some cases, genotyping of a non-human animal herein can comprise full genome sequencing analysis.

In some cases, insertion of a transgene in an animal can be validated by sequencing (e.g., next-generation sequencing) a part of the transgene or the entire transgene. For example, insertion of a transgene adjacent to a Rosa26 promoter in a pig can be validated by next generation sequencing of Rosa exons 1 to 4, e.g., using the forward primer 5'-cgcctagagaagaggctgtg-3' (SEQ ID No. 35), and reverse primer 5'-ctgctgtggctgtggtgtag-3' (SEQ ID No. 36).

TABLE 2 cDNA sequences of exemplary transgenes

| SEQ ID No. | Gene | Accession No. |
|---|---|---|
| 37 | CD46 | NM_213888 |
| 38 | CD55 | AF228059.1 |
| 39 | CD59 | AF020302 |
| 40 | ICP47 | EU445532.1 |
| 41 | HLA-G1 | NM_002127.5 |
| 42 | HLA-E | NM_005516.5 |
| 43 | Human β-2-microglobulin | NM_004048.2 |
| 44 | Human PD-L1 | NM_001267706.1 |
| 45 | Human PD-L2 | NM_025239.3 |
| 46 | Human Spi9 | NM_004155.5 |
| 47 | Human CD47 | NM_001777.3 |
| 48 | Human galectin-9 | NM_009587.2 |

TABLE 3

Sequences of proteins encoded by exemplary transgenes

| SEQ ID No. | Protein | Accession No. |
|---|---|---|
| 49 | CD46 | NP_999053.1 |
| 50 | CD55 | AAG14412.1 |
| 51 | CD59 | AAC67231.1 |
| 52 | ICP47 | ACA28836.1 |
| 53 | HLA-G1 | NP_002118.1 |
| 54 | HLA-E | NP_005507.3 |
| 55 | Human β-2-microglobulin | NP_004039.1 |
| 56 | Human PD-L1 | NP_001254635.1 |
| 57 | Human PD-L2 | NP_079515.2 |
| 58 | Human Spi9 | NP_004146.1 |
| 59 | Human CD47 | NP_001768.1 |
| 60 | Human galectin-9 | NP_033665.1 |

Populations of Non-Human Animals

Provided herein is a single non-human animal and also a population of non-human animals. A population of non-human animals can be genetically identical. A population of non-human animals can also be phenotypical identical. A population of non-human animals can be both phenotypical and genetically identical.

Further provided herein is a population of non-human animals, which can be genetically modified. For example, a population can comprise at least or at least about 2, 5, 10, 50, 100, or 200, non-human animals as disclosed herein. The non-human animals of a population can have identical phenotypes. For example, the non-human animals of a population can be clones. A population of non-human animal can have identical physical characteristics. The non-human animals of a population having identical phenotypes can comprise a same transgene(s). The non-human animals of a population having identical phenotypes can also comprise a same gene(s) whose expression is reduced. The non-human animals of a population having identical phenotypes can also comprise a same gene(s) whose expression is reduced and comprise a same transgene(s). A population of non-human animals can comprise at least or at least about 2, 5, 10, 50, 100, or 200, non-human animals having identical phenotypes. For example, the phenotypes of any particular litter can have the identical phenotype (e.g., in one example, anywhere from 1 to about 20 non-human animals). The non-human animals of a population can be pigs having identical phenotypes.

The non-human animals of a population can have identical genotypes. For example, all nucleic acid sequences in the chromosomes of non-human animals in a population can be identical. The non-human animals of a population having identical genotypes can comprise a same transgene(s). The non-human animals of a population having identical genotypes can also comprise a same gene(s) whose expression is reduced. The non-human animals of a population having identical genotypes can also comprise a same gene(s) whose expression is reduced and comprise a same transgene(s). A population of non-human animals can comprise at least or at least about 2, 5, 50, 100, or 200 non-human animals having identical genotypes. The non-human animals of a population can be pigs having identical genotypes.

Cells from two or more non-human animals with identical genotypes and/or phenotypes can be used in a tolerizing vaccine. In some cases, a tolerizing vaccine disclosed herein can comprise a plurality of the cells (e.g., genetically modified cells) from two or more non-human animals (e.g., pigs) with identical genotypes and/or phenotypes. A method for immunotolerizing a recipient to a graft can comprise administering to the recipient a tolerizing vaccine comprising a plurality of cells (e.g., genetically modified cells) from two or more non-human animals with identical genotypes or phenotypes.

Cells from two or more non-human animals with identical genotypes and/or phenotypes can be used in transplantation. In some cases, a graft (e.g., xenograft or allograft) can comprise a plurality of cells from two or more non-human animals with identical genotypes and/or phenotypes. In embodiments of the methods described herein, e.g., a method for treating a disease in a subject in need thereof, can comprise transplanting a plurality of cells (e.g., genetically modified cells) from two or more non-human animals with identical genotypes and/or phenotypes.

Populations of non-human animals can be generated using any method known in the art. In some cases, populations of non-human animals can be generated by breeding. For example, inbreeding can be used to generate a phenotypically or genetically identical non-human animal or population of non-human animals. Inbreeding, for example, sibling to sibling or parent to child, or grandchild to grandparent, or great grandchild to great grandparent, can be used. Successive rounds of inbreeding can eventually produce a phenotypically or genetically identical non-human animal. For example, at least or at least about 2, 3, 4, 5, 10, 20, 30, 40, or 50 generations of inbreeding can produce a phenotypically and/or a genetically identical non-human animal. It is thought that after 10-20 generations of inbreeding, the genetic make-up of a non-human animal is at least 99% pure. Continuous inbreeding can lead to a non-human animal that is essentially isogenic, or close to isogenic as a non-human animal can be without being an identical twin.

Breeding can be performed using non-human animals that have the same genotype. For example, the non-human animals have the same gene(s) whose expression is reduced and/or carry the same transgene(s). Breeding can also be performed using non-human animals having different genotypes. Breeding can be performed using a genetically modified non-human animal and non-genetically modified non-human animal, for example, a genetically modified female pig and a wild-type male pig, or a genetically modified male pig and a wild-type female pig. All these combinations of breeding can be used to produce a non-human animal of desire.

Populations of genetically modified non-human animals can also be generated by cloning. For example, the populations of genetically modified non-human animal cells can be asexually producing similar populations of genetically or phenotypically identical individual non-human animals. Cloning can be performed by various methods, such as twinning (e.g., splitting off one or more cells from an embryo and grow them into new embryos), somatic cell nuclear transfer, or artificial insemination. More details of the methods are provided throughout the disclosure.

II. Genetically Modified Cells

Disclosed herein are one or more genetically modified cells that can be used to treat or prevent disease. These genetically modified cells can be from genetically modified non-human animals. For example, genetically modified non-human animals as disclosed above can be processed so that one or more cells are isolated to produce isolated genetically modified cells. These isolated cells can also in some cases be further genetically modified cells. However, a cell can be modified ex vivo, e.g., outside an animal using modified or non-modified human or non-human animal cells. For example, cells (including human and non-human animal cells) can be modified in culture. It is also contemplated that a genetically modified cell can be used to generate a genetically modified non-human animal described herein. In some cases, the genetically modified cell can be isolated from a genetically modified animal. In some cases, the genetically modified cell can be derived from a cell from a non-genetically modified animal. Isolation of cells can be performed by methods known in the art, including methods of primary cell isolation and culturing. It is specifically contemplated that a genetically modified cell is not extracted from a human.

Therefore, anything that can apply to the genetically modified non-human animals including the various methods of making as described throughout can also apply herein. For example, all the genes that are disrupted and the transgenes that are overexpressed are applicable in making genetically modified cells used herein. Further, any methods for testing the genotype and expression of genes in the genetically modified non-human animals described throughout can be used to test the genetic modification of the cells.

A genetically modified cell can be from a member of the Laurasiatheria superorder or a non-human primate. Such genetically modified cell can be isolated from a member of the Laurasiatheria superorder or a non-human primate. Alternatively, such genetically modified cell can be originated from a member of the Laurasiatheria superorder or a non-human primate. For example, the genetically modified cell can be made from a cell isolated from a member of the Laurasiatheria superorder or a non-human primate, e.g., using cell culturing or genetic modification methods.

Genetically modified cells, e.g., cells from a genetically modified animal or cells made ex vivo, can be analyzed and sorted. In some cases, genetically modified cells can be analyzed and sorted by flow cytometry, e.g., fluorescence-activated cell sorting. For example, genetically modified cells expressing a transgene can be detected and purified from other cells using flow cytometry based on a label (e.g., a fluorescent label) recognizing the polypeptide encoded by the transgene.

Stem cells, including, non-human animal and human stem cells can be used. Stem cells do not have the capability to generating a viable human being. For example, stem cells can be irreversibly differentiated so that they are unable to generate a viable human being. Stem cells can be pluripotent, with the caveat that the stem cells cannot generate a viable human.

As discussed above in the section regarding the genetically modified non-human animals, the genetically modified cells can comprise one or more genes whose expression is reduced. The same genes as disclosed above for the genetically modified non-human animals can be disrupted. For example, a genetically modified cell comprising one or more genes whose expression is disrupted, e.g., reduced, where the one or more genes comprise NLRC5, TAP1, GGTA1, B4GALNT2, CMAH, CXCL10, MICA, MICB, C3, CIITA and/or any combination thereof. Further, the genetically modified cell can comprise one or more transgenes comprising one or more polynucleotide inserts. For example, a genetically modified cell can comprise one or more transgenes comprising one or more polynucleotide inserts of ICP47, CD46, CD55, CD 59, HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, galectin-9, any functional fragments thereof, or any combination thereof. A genetically modified cell can comprise one or more reduced genes and one or more transgenes. For example, one or more genes whose expression is reduced can comprise any one of NLRC5, TAP1, GGTA1, B4GALNT2, CMAH, CXCL10, MICA, MICB, CIITA, and/or any combination thereof, and one or more transgene can comprise ICP47, CD46, CD55, CD 59, HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, galectin-9, any functional fragments thereof, and/or any combination thereof. In some cases, a genetically modified cell can comprise reduced expression of NLRC5, C3, GGTA1, CMAH, and B4GALNT2, and transgenes comprising polynucleotides encoding proteins or functional fragments thereof, where the proteins comprise HLA-G1, Spi9, PD-L1, PD-L2, CD47, and galectin-9. In some cases, a genetically modified cell can comprise reduced expression of TAP1, C3, GGTA1, CMAH, and B4GALNT2, and transgenes comprising polynucleotides encoding proteins or functional fragments thereof, where the proteins comprise HLA-G1, Spi9, PD-L1, PD-L2, CD47, and galectin-9. In some cases, a genetically modified cell can comprise reduced expression of NLRC5, TAP1, C3, GGTA1, CMAH, and B4GALNT2, and transgenes comprising polynucleotides encoding proteins or functional fragments thereof, where the proteins comprise HLA-G1, Spi9, PD-L1, PD-L2, CD47, and galectin-9. In some cases, CD47, PD-L1, and PD-L2 encoded by the transgenes herein can be human CD47, human PD-L1 and human PD0-L2. In some cases, the genetically modified cell can be coated with CD47 on its surface. Coating of CD47 on the surface of a cell can be accomplished by biotinylating the cell surface followed by incubating the biotinylated cell with a streptavidin-CD47 chimeric protein. The coated CD47 can be human CD47.

As discussed above in the section regarding the genetically modified non-human animals, the genetically modified cell can comprise 1, 2, 3, 4, 5, 6, 7, 8, 9, 10, 11, 12, 13, 14, 15, 16, 17, 18, 19, 20 or more disrupted genes. A genetimodified cell can also comprise 1, 2, 3, 4, 5, 6, 7, 8, 9, 10, 11, 12, 13, 14, 15, 16, 17, 18, 19, 20, or more transgenes.

As discussed in detail above, a genetically modified cell, e.g., porcine cell, can also comprise dominant negative transgenes and/or transgenes expressing one or more knock-down genes. Also as discussed above, expression of a transgene can be controlled by one or more promoters.

A genetically modified cell can be one or more cells from tissues or organs, the tissues or organs including brain, lung, liver, heart, spleen, pancreas, small intestine, large intestine, skeletal muscle, smooth muscle, skin, bones, adipose tissues, hairs, thyroid, trachea, gall bladder, kidney, ureter, bladder, aorta, vein, esophagus, diaphragm, stomach, rectum, adrenal glands, bronchi, ears, eyes, retina, genitals, hypothalamus, larynx, nose, tongue, spinal cord, or ureters, uterus, ovary and testis. For example, a genetically modified cell, e.g., porcine cell, can be from brain, heart, liver, skin, intestine, lung, kidney, eye, small bowel, or pancreas. In some cases, a genetically modified cell can be from a pancreas. More specifically, pancreas cells can be islet cells. Further, one or more cells can be pancreatic α cells, pancreatic β cells, pancreatic δ cells, pancreatic F cells (e.g., PP cells), or pancreatic ε cells. For example, a genetically modified cell can be pancreatic β cells. Tissues or organs disclosed herein can comprise one or more genetically modified cells. The tissues or organs can be from one or more genetically modified animals described in the application, e.g., pancreatic tissues such as pancreatic islets from one or more genetically modified pigs.

A genetically modified cell, e.g., porcine cell, can comprise one or more types of cells, where the one or more types of cells include Trichocytes, keratinocytes, gonadotropes, corticotropes, thyrotropes, somatotropes, lactotrophs, chromaffin cells, parafollicular cells, *glomus* cells melanocytes, nevus cells, merkel cells, odontoblasts, cementoblasts corneal keratocytes, retina muller cells, retinal pigment epithelium cells, neurons, glias (e.g., oligodendrocyte astrocytes), ependymocytes, pinealocytes, pneumocytes (e.g., type I pneumocytes, and type II pneumocytes), clara cells, goblet cells, G cells, D cells, ECL cells, gastric chief cells, parietal cells, foveolar cells, K cells, D cells, I cells, goblet cells, paneth cells, enterocytes, microfold cells, hepatocytes, hepatic stellate cells (e.g., Kupffer cells from mesoderm), cholecystocytes, centroacinar cells, pancreatic stellate cells, pancreatic α cells, pancreatic β cells, pancreatic δ cells, pancreatic F cells (e.g., PP cells), pancreatic ε cells, thyroid (e.g., follicular cells), parathyroid (e.g., parathyroid chief cells), oxyphil cells, urothelial cells, osteoblasts, osteocytes, chondroblasts, chondrocytes, fibroblasts, fibrocytes, myoblasts, myocytes, myosatellite cells, tendon cells, cardiac muscle cells, lipoblasts, adipocytes, interstitial cells of cajal, angioblasts, endothelial cells, mesangial cells (e.g., intraglomerular mesangial cells and extraglomerular mesangial cells), juxtaglomerular cells, macula *densa* cells, stromal cells, interstitial cells, telocytes simple epithelial cells, podocytes, kidney proximal tubule brush border cells, sertoli cells, leydig cells, granulosa cells, peg cells, germ cells, spermatozoon ovums, lymphocytes, myeloid cells, endothelial progenitor cells, endothelial stem cells, angioblasts, mesoangioblasts, and pericyte mural cells. A genetically modified cell can potentially be any cells used in cell therapy. For example, cell therapy can be pancreatic β cells supplement or replacement to a disease such as diabetes.

A genetically modified cell, e.g., porcine cell, can be from (e.g., extracted from) a non-human animal. One or more cells can be from a mature adult non-human animal. However, one or more cells can be from a fetal or neonatal tissue.

Depending on the disease, one or more cells can be from a transgenic non-human animal that has grown to a sufficient size to be useful as an adult donor, e.g., an islet cell donor. In some cases, non-human animals can be past weaning age. For example, non-human animals can be at least or at least about six months old. In some cases, non-human animals can be at least or at least about 18 months old. A non-human animal in some cases, survive to reach breeding age. For example, islets for xenotransplantation can be from neonatal (e.g., age 3-7 days) or pre-weaning (e.g., age 14 to 21 days) donor pigs. One or more genetically modified cells, e.g., porcine cells, can be cultured cells. For example, cultured cells can be from wild-type cells or from genetically modified cells (as described herein). Furthermore, cultured cells can be primary cells. Primary cells can be extracted and frozen, e.g., in liquid nitrogen or at −20° C. to −80° C. Cultured cells can also be immortalized by known methods, and can be frozen and stored, e.g., in liquid nitrogen or at −20° C. to −80° C.

Genetically modified cells, e.g., porcine cells, as described herein can have a lower risk of rejection, when compared to when a wild-type non-genetically modified cell is transplanted.

Disclosed herein is a vector comprising a polynucleotide sequence of ICP47, CD46, CD55, CD59, HLA-E, HLA-G (e.g., HLA-G1, HLA-G2, HLA-G3, HLA-G4, HLA-G5, HLA-G6, or HLA-G7), B2M, Spi9, PD-L1, PD-L2, CD47, galectin-9, any functional fragments thereof, or any combination thereof. These vectors can be inserted into a genome of a cell (by transfection, transformation, viral delivery, or any other known method). These vectors can encode ICP47, CD46, CD55, CD59, HLA-E, HLA-G (e.g., HLA-G1, HLA-G2, HLA-G3, HLA-G4, HLA-G5, HLA-G6, or HLA-G7), B2M Spi9, PD-L1, PD-L2, CD47, and/or galectin-9 proteins or functional fragments thereof.

Vectors contemplated include, but not limited to, plasmid vectors, artificial/mini-chromosomes, transposons, and viral vectors. Further disclosed herein is an isolated or synthetic nucleic acid comprising an RNA, where the RNA is encoded by any sequence in Table 2. RNA can also encode for any sequence that exhibits at least or at least about 50%, 60%, 70%, 80%, 90%, 95%, 99%, or 100% homology to any sequence in Table 2. RNA can also encode for any sequence that exhibits at least or at least about 50%, 60%, 70%, 80%, 90%, 95%, 99%, or 100% identity to any sequence in Table 2.

RNA can be a single-chain guide RNA. The disclosure also provides an isolated or synthesized nucleic acid comprising any sequence in Table 1. RNA can also provide an isolated or synthesized nucleic acid that exhibits at least or at least about 50%, 60%, 70%, 80%, 90%, 95%, 99%, or 100% homology to any sequence in Table 1. RNA can also provide an isolated or synthesized nucleic acid that exhibits at least or at least about 50%, 60%, 70%, 80%, 90%, 95%, 99%, or 100% identity to any sequence in Table 1.

Guide RNA sequences can be used in targeting one or more genes in a genome of a non-human animal. For example, guide RNA sequence can target a single gene in a genome of non-human animal. In some cases, guide RNA sequences can target one or more target sites of each of one or more genes in a genome of a non-human animal.

Genetically modified cells can also be leukocytes, lymphocytes, B lymphocytes, or any other cell such as islet cells, islet beta cells, or hepatocytes. These cells can be fixed or made apopototic by any method disclosed herein, e.g., by ECDI fixation.

A genetically modified cells can be derived (e.g., retrieved) from a non-human fetal animal, perinatal non-human animal, neonatal non-human animal, preweaning non-human animal, young adult non-human animal, adult non-human animal, or any combination thereof. In some cases, a genetically modified non-human animal cell can be derived from an embryonic tissue, e.g., an embryonic pancreatic tissue. For example, a genetically modified cell can be derived (e.g., retrieved) from an embryonic pig pancreatic tissue from embryonic day 42 (E42).

The term "fetal animal" and its grammatical equivalents can refer to any unborn offspring of an animal. The term "perinatal animal" and its grammatical equivalents can refer to an animal immediately before or after birth. For example, a perinatal period can start from 20th to 28th week of gestation and ends 1 to 4 weeks after birth. The term "neonatal animal" and its grammatical equivalents can refer to any new born animals. For example, a neonatal animal can be an animal born within a month. The term "preweaning non-human animal" and its grammatical equivalents can refer to any animal before being withdrawn from the mother's milk.

Genetically modified non-human animal cells can be formulated into a pharmaceutical composition. For example, the genetically modified non-human animal cells can be combined with a pharmaceutically acceptable excipient. An excipient that can be used is saline. The pharmaceutical composition can be used to treat patients in need of transplantation.

A genetically modified cell can comprise reduced expression of any genes, and/or any transgenes disclosed herein. Genetic modification of the cells can be done by using any of the same method as described herein for making the genetically modified animals. In some cases, a method of making a genetically modified cell originated from a non-human animal can comprise reducing expression of one or more genes and/or inserting one or more transgenes. The reduction of gene expression and/or transgene insertion can be performed using any methods described in the application, e.g., gene editing.

Genetically Modified Cells Derived from Stem Cells

Genetically modified cells can be a stem cell. These genetically modified stem cells can be used to make a potentially unlimited supply of cells that can be subsequently processed into fixed or apoptotic cells by the methods disclosed herein. As discussed above, stem cells are not capable of generating a viable human being.

The production of hundreds of millions of insulin-producing, glucose-responsive pancreatic beta cells from human pluripotent stem cells provides an unprecedented cell source for cell transplantation therapy in diabetes (Pagliuca et al., 2014). Other human stem cell-(embryonic, pluripotent, placental, induced pluripotent, etc.) derived cell sources for cell transplantation therapy in diabetes and in other diseases are being developed.

These stem cell-derived cellular grafts are subject to rejection. The rejection can be mediated by CD8+ T cells. In Type 1 diabetic recipients, human stem cell-derived functional beta cells are subject to rejection and autoimmune recurrence. Both are thought to be mediated by CD8+ T cells.

To interfere with activation and effector function of these allo-reactive and auto-reactive CD8+ T cells, established molecular methods of gene modification, including CRISP/Cas9 gene targeting, can be used to mutate the NLRC5, TAP1, and/or B2M genes in human stem cells for the purpose of preventing cell surface expression of functional MHC class I in the stem cell-derived, partially or fully differentiated cellular graft. Thus, transplanting human stem cell-derived cellular grafts lacking functional expression of MHC class I can minimize the requirements of immunosuppression otherwise required to prevent rejection and autoimmune recurrence.

However, lack of MHC class I expression on transplanted human cells will likely cause the passive activation of natural killer (NK) cells (Ohlen et al, 1989). NK cell cytotoxicity can be overcome by the expression of the human MHC class 1 gene, HLA-E, which stimulates the inhibitory receptor CD94/NKG2A on NK cells to prevent cell killing (Weiss et al., 2009; Lilienfeld et al., 2007; Sasaki et al., 1999). Successful expression of the HLA-E gene was dependent on co-expression of the human B2M (beta 2 microglobulin) gene and a cognate peptide (Weiss et al., 2009; Lilienfeld et al., 2007; Sasaki et al., 1999; Pascasova et al., 1999). A nuclease mediated break in the stem cell DNA allows for the insertion of one or multiple genes via homology directed repair. The HLA-E and hB2M genes in series can be integrated in the region of the nuclease mediated DNA break thus preventing expression of the target gene (for example, NLRC5) while inserting the transgenes.

To further minimize, if not eliminate, the need for maintenance immunosuppression in recipients of stem cell derived cellular grafts lacking functional expression of MHC class I, recipients of these grafts can also be treated with tolerizing apoptotic donor cells disclosed herein.

The methods for the production of insulin-producing pancreatic beta cells (Pagliuca et al., 2014) can potentially be applied to non-human (e.g., pig) primary isolated pluripotent, embryonic stem cells or stem-like cells (Goncalves et al., 2014; Hall et al. V. 2008). However, the recipient of these insulin-producing pancreatic beta cells likely has an active immune response that threatens the success of the graft. To overcome antibody-mediated and CD8+ T cell immune attack, the donor animal can be genetically modified before isolation of primary non-human pluripotent, embryonic stem cells or stem-like cells to prevent the expression of the GGTA1, CMAH, B4GalNT2, or MHC class I-related genes as disclosed throughout the application. The pluripotent, embryonic stem cells or stem-like cells isolated from genetically modified animals could then be differentiated into millions of insulin-producing pancreatic beta cells.

Xenogeneic stem cell-derived cell transplants can be desirable in some cases. For example, the use of human embryonic stem cells may be ethically objectionable to the recipient. Therefore, human recipients may feel more comfortable receiving a cellular graft derived from non-human sources of embryonic stem cells.

Non-human stem cells may include pig stem cells. These stem cells can be derived from wild-type pigs or from genetically engineered pigs. If derived from wild-type pigs, genetic engineering using established molecular methods of gene modification, including CRISP/Cas9 gene targeting, may best be performed at the stem cell stage. Genetic engineering may be targeted to disrupt expression of NLRC5, TAP1, and/or B2M genes to prevent functional expression of MHC class I. Disrupting genes such as NLRC5, TAP1, and B2M in the grafts can cause lack of functional expression of MHC class I on graft cells including on islet beta cells, thereby interfering with the post-transplant activation of autoreactive CD8+ T cells. Thus, this can protect the transplant, e.g., transplanted islet beta cells, from the cytolytic effector functions of autoreactive CD8+ T cells.

However, as genetic engineering of stem cells may alter their potential for differentiation, an approach can be to generate stem cell lines from genetically engineered pigs, including those pigs, in whom the expression of NLRC5, TAP1, and/or B2M genes has been disrupted.

Generation of stem cells from pigs genetically modified to prevent the expression also of the GGTA1, CMAH, B4GalNT2 genes or modified to express transgenes that encode for complement regulatory proteins CD46, CD55, or CD59, as disclosed throughout the application, could further improve the therapeutic use of the insulin-producing pancreatic beta cells or other cellular therapy products. Likewise, the same strategy as described herein can be used in other methods and compositions described throughout.

Like in recipients of human stem cell-derived cellular grafts lacking functional expression of MHC class I, the need for maintenance immunosuppression in recipients of pig stem cell-derived grafts can be further minimized by peritransplant treatments with tolerizing apoptotic donor cells.

III. Tolerizing Vaccines

Figure 3:
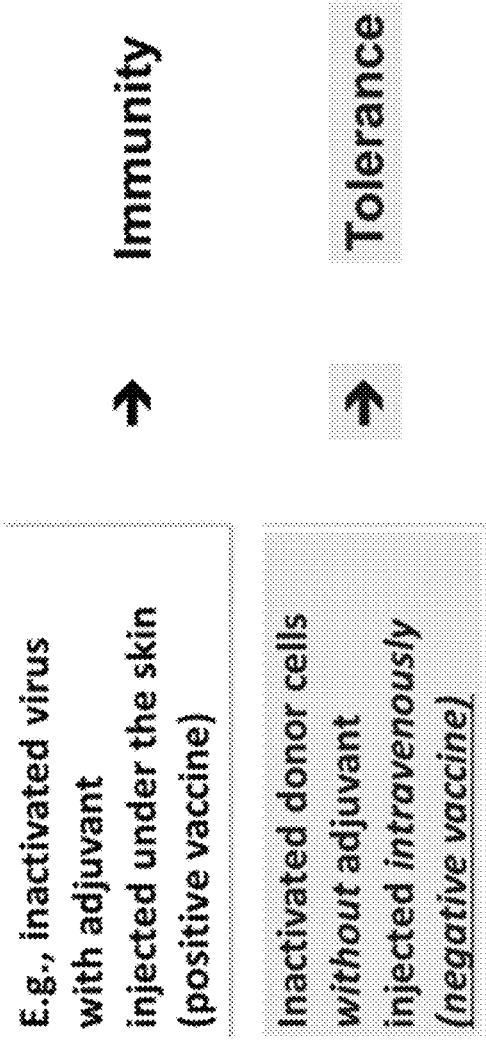
FIG. 3 demonstrates use of positive and tolerizing vaccines (also referred to as a negative vaccine).

Traditionally, vaccines are used to confer immunity to a host. For example, injecting an inactivated virus with adjuvant under the skin can lead to temporary or permanent immunity to the active and/or virulent version of the virus. This can be referred to as a positive vaccine (FIG. 3). However, inactivated cells (e.g., cells from a donor or an animal genetically different from the donor) that is injected intravenously, can result in tolerance of a donor cells, or cells with similar cellular markers. This can be referred to as a tolerizing vaccine (also referred to as a negative vaccine) (FIG. 3). The inactive cells can be injected without an adjuvant. Alternatively, the inactive cells can be injected with an adjuvant. These tolerizing vaccines can be advantageous in transplantation, for example, in xenotransplantation, by tolerizing a recipient and preventing rejection. Tolerization can be conferred to a recipient without the use of immunosuppressive therapies. However, in some cases, other immunosuppressive therapies in combination with tolerizing vaccines, can decrease transplantation rejection.

Figure 4:
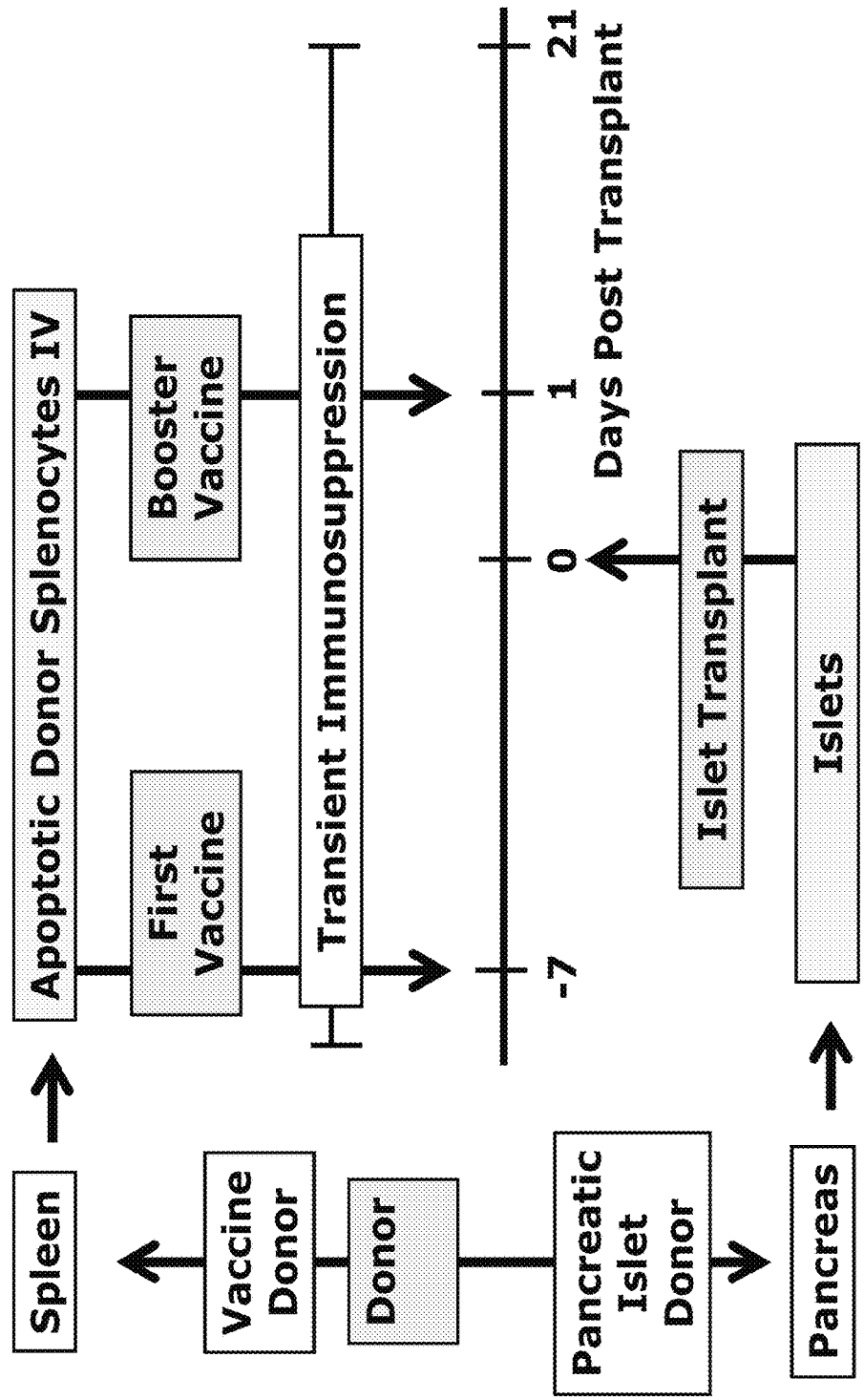
FIG. 4 demonstrates an exemplary approach to extending the survival of xenografts in a subject with infusion of apoptotic donor splenocytes for tolerizing vaccination under the cover of transient immunosuppression.

FIG. 4 demonstrates an exemplary approach to extending the survival of transplanted grafts (e.g., xenografts) in a subject (e.g., a human or a non-human primate) with infusion (e.g., intravenous infusion) of apoptotic cells from the donor for tolerizing vaccination under the cover of transient immunosuppression. A donor can provide xenografts for transplantation (e.g., islets), as well as cells (e.g., splenocytes) as a tolerizing vaccine. The tolerizing vaccine cells can be apoptotic cells (e.g., by ECDI fixation) and administered to the recipient before (e.g., the first vaccine, on day 7 before the transplantation) and after the transplantation (e.g., the booster vaccine, on day 1 after the transplantation). The tolerizing vaccine can provide transient immunosuppression that extends the time of survival of the transplanted grafts (e.g., islets).

Tolerizing vaccines can comprise one or more of the following types of cells: i) apoptotic cells comprising genotypically identical cells with reduced expression of GGTA1 alone, or GGTA1 and CMAH, or GGTA1, CMAH, and B4GALNT2. This can minimize or eliminate cell-mediated immunity and cell-dependent antibody-mediated immunity to organ, tissue, cell, and cell line grafts (e.g., xenografts) from animals that are genotypically identical with the apoptotic cell vaccine donor animal, or from animals that have undergone additional genetic modifications (e.g., suppression of NLRC5, TAP1, MICA, MICB, CXCL10, C3, CIITA genes or expression of transgenes comprising two or more polynucleotide inserts of ICP47, CD46, CD55, HLA-E, HLA-G (e.g., HLA-G1, HLA-G2, HLA-G3, HLA-G4, HLA-G5, HLA-G6, or HLA-G7), B2M, CD59, or any functional fragments thereof), but are genotypically similar to the donor animal from which the apoptotic cell vaccine is derived; ii) apoptotic stem cell (e.g., embryonic, pluripotent, placental, induced pluripotent, etc.)-derived donor cells (e.g., leukocytes, lymphocytes, T lymphocytes, B lymphocytes, red blood cells, graft cells, or any other donor cell) for minimizing or eliminating cell-mediated immunity and cell-dependent antibody-mediated immunity to organ, tissue, cell, and cell line grafts (e.g., xenografts) from animals that are genotypically identical with the apoptotic cell vaccine donor animal or from animals that have undergone additional genetic modifications (e.g., suppression of NLRC5, TAP1, MICA, MICB, CXCL10, C3, CIITA genes or expression of transgenes comprising two or more polynucleotide inserts of ICP47, CD46, CD55, HLA-E, HLA-G (e.g., HLA-G1, HLA-G2, HLA-G3, HLA-G4, HLA-G5, HLA-G6, or HLA-G7), B2M, CD59, or any functional fragments thereof), but are genotypically similar to the donor animal from which the apoptotic stem cell-derived cell vaccine is derived; iii) apoptotic stem cell (e.g., embryonic, pluripotent, placental, induced pluripotent, etc.)-derived donor cells (leukocytes, lymphocytes, T lymphocytes, B lymphocytes, red blood cells, graft cells such as functional islet beta cells, or any other donor cell) for minimizing or eliminating cell-mediated immunity and cell-dependent antibody-mediated immunity to organ, tissue, cell, and cell grafts (e.g., allografts) that are genotypically identical with the human stem cell line or to grafts (e.g., allografts) derived from the same stem cell line that have undergone genetic modifications (e.g., suppression of NLRC5, TAP1, MICA, MICB, CXCL10, C3, CIITA genes) but are otherwise genotypically similar to the apoptotic human stem cell-derived donor cell vaccine; iv) apoptotic donor cells, where the cells are made apoptotic by UV irradiation, gamma-irradiation, or other methods not involving incubation in the presence of ECDI. In some cases, tolerizing vaccine cells can be adminstered, e.g., infused (in some cases repeatedly infused) to a subject in need thereof. Tolerizing vaccines can be produced by disrupting (e.g., reducing expression) one or more genes from a cell. For example, genetically modified cells as described throughout the application can be used to make a tolerizing vaccine. For example, cells can have one or more genes that can be disrupted (e.g., reduced expression) including glycoprotein galactosyltransferase alpha 1,3 (GGTA1), putative cytidine monophosphate-N-acetylneuraminic acid hydroxylase-like protein (CMAH), B4GALNT2, and/or any combination thereof. For example, a cell can have disrupted GGTA1 only, or disrupted CMAH only, or disrupted B4GALNT2 only. A cell can also have disrupted GGTA1 and CMAH, disrupted GGTA1 and B4GALNT2, or disrupted CMAH and B4GALNT2. A cell can have disrupted GGTA1, CMAH, and B4GALNT2. In some cases, the disrupted gene does not include GGTA1. A cell can also express NLRC5 (endogenously or exogenously), while GGTA1 and/or CMAH are disrupted. A cell can also have disrupted C3.

A tolerizing vaccine can be produced with cells comprising additionally expressing one or more transgenes, e.g., as described throughout the application. For example, a tolerizing vaccine can comprise a cell comprising one or more transgenes comprising one or more polynucleotide inserts of Infected cell protein 47 (ICP47), Cluster of differentiation 46 (CD46), Cluster of differentiation 55 (CD55), Cluster of differentiation 59 (CD 59), HLA-E, HLA-G (e.g., HLA-G1, HLA-G2, HLA-G3, HLA-G4, HLA-G5, HLA-G6, or HLA-G7), B2M, PD-L1, PD-L2, CD47, any functional fragments thereof, or any combination thereof. In some cases, a tolerizing vaccine can comprise a genetically modified cell comprising reduced protein expression of GGTA1, CMAH, and B4GALNT2, and transgenes comprising polynucleotides encoding proteins or functional fragments thereof, where the proteins comprise HLA-G1, PD-L1, PD-L2, and CD47. In some cases, a tolerizing vaccine can comprise a genetically modified cell comprising reduced protein expression of GGTA1, CMAH, and B4GALNT2, and transgenes comprising polynucleotides encoding proteins or functional fragments thereof, where the proteins comprise HLA-E, PD-L1, PD-L2, and CD47. In some cases, a tolerizing vaccine can comprise a cell coated with CD47 on its surface. Coating of CD47 on the surface of a cell can be accomplished by biotinylating the cell surface followed by incubating these biotinylated cells with a streptavidin-CD47 chimeric protein. For example, a tolerizing vaccine can comprise a cell coated with CD47 on its surface, where the cell comprises reduced protein expression of GGTA1, CMAH, and B4GALNT2, and transgenes comprising polynucleotides encoding proteins or functional fragments thereof, where the proteins comprise HLA-G1, PD-L1, and PD-L2. A CD47-coated cell can be a non-apoptotic cell. Alternative, a CD47 coated cell can be an apoptotic cell.

When administered in a subject, a cell of a tolerizing vaccine can have a circulation half-life. A cell of a tolerizing vaccine can have a circulation half-life of at least or at least about 0.1, 0.5, 1, 2, 3, 4, 5, 6, 7, 8, 9, 10, 12, 18, 24, 36, 48, 60, or 72 hours. For example, the circulation half-life of the tolerizing vaccine can be from or from about 0.1 to 0.5; 0.5 to 1.0; 1.0 to 2.0; 1.0 to 3.0; 1.0 to 4.0; 1.0 to 5.0; 5 to 10; 10 to 15; 15 to 24; 24 to 36; 36 to 48; 48 to 60; or 60 to 72 hours. A cell in a tolerizing vaccine can be treated to enhance its circulation half-life. Such treatment can include coating the cell with a protein, e.g., CD47. A cell treated to enhance its circulation half-life can be a non-apoptotic cell. A cell treated to enhance its circulation half-life can be an apoptotic cell. Alternatively, a cell in a tolerizing vaccine can be genetically modified (e.g., insertion of a transgene such as CD47 in its genome) to enhance its circulation half-life. A cell genetically modified to enhance its circulation half-life can be a non-apoptotic cell. A cell genetically modified to enhance its circulation half-life can be an apoptotic cell.

A tolerizing vaccine can have both one or more disrupted genes (e.g., reduced expression) and one or more transgenes. Any genes and/or transgenes as described herein can be used.

A cell that comprises one or more disrupted genes (e.g., reduced expression) can be used as, or be a part of, a tolerizing vaccine. In other words, a cell that comprises one or more disrupted genes can be or can be made into a tolerizing vaccine.

A tolerizing vaccine can have the same genotype and/or phenotype as cells, organs, and/or tissues used in transplantation. Sometimes, the genotype and/or phenotype of a tolerizing vaccine and a transplant are different. A tolerizing vaccine used for a transplant recipient can comprise cells from the transplant graft donor. A tolerizing vaccine used for a transplant recipient can comprise cells that are genetically and/or phenotypically different from the transplant graft. In some cases, a tolerizing vaccine used for a transplant recipient can comprise cells from the transplant graft donor and cells that are genetically and/or phenotypically different from the transplant graft. The cells that are genetically and/or phenotypically different from the transplant graft can be from an animal of the same species of the transplant graft donor.

A source of cells for a tolerizing vaccine can be from a human or non-human animal.

Figure 5:
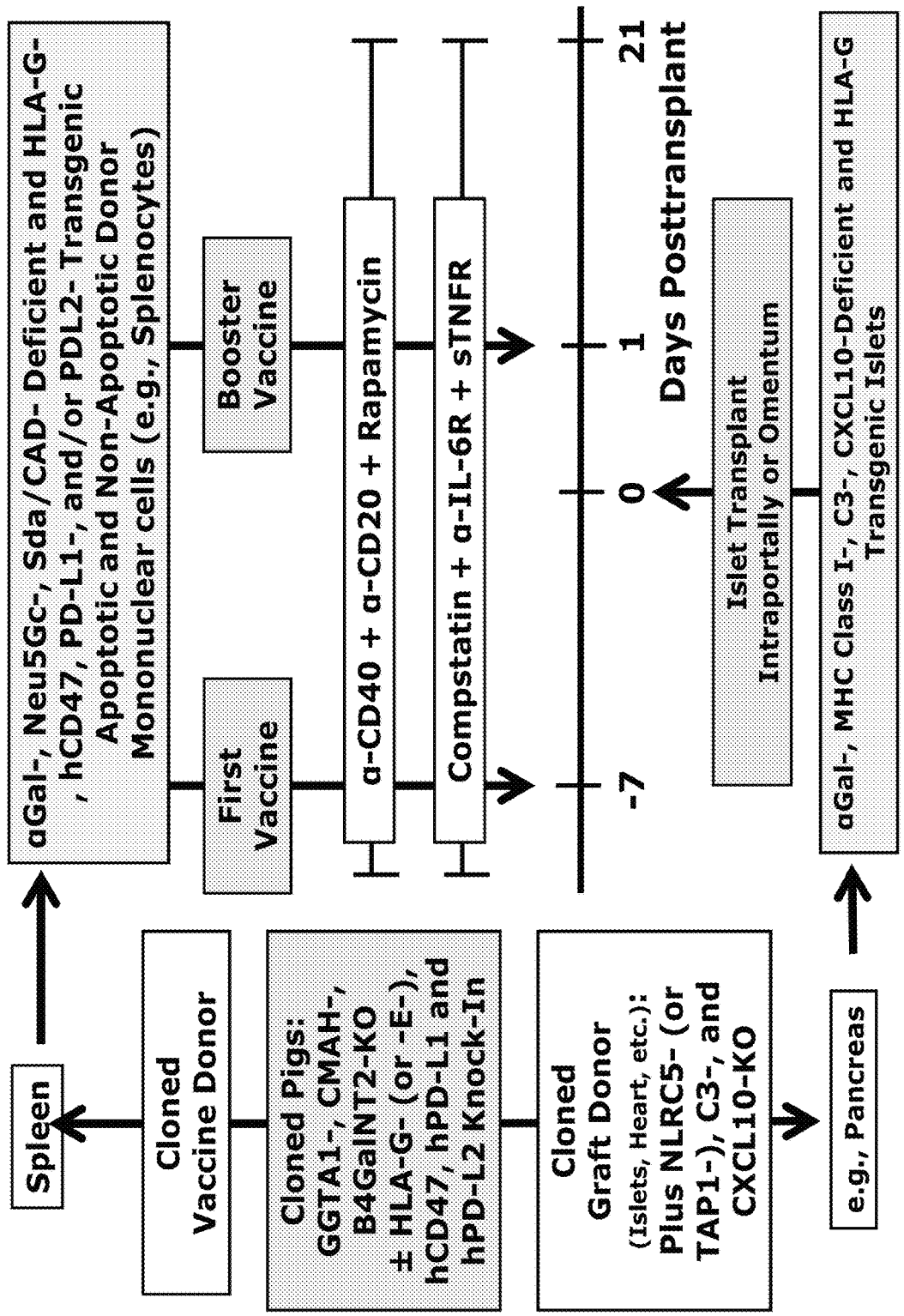
FIG. 5 shows an exemplary approach to preventing rejection or extending survival of xenografts in a recipient in the absence of chronic and generalized immunosuppression of the xenograft recipient. This exemplary approach includes and integrates three components: i) genetically engineered islets with deficient and/or reduced expression of αGal, MHC class I, complement C3, and CXCL10 and transgenic expression the HLA-G; ii) genetically engineered donor apoptotic and non-apoptotic mononuclear cells (e.g., splenocytes) with deficient and/or reduced expression of αGal, Neu5Gc, and Sda/CAD as well as transgenic expression of HLA-G with or without human CD47, human PD-L1, human PD-L2 (e.g., the genetically engineered vaccine); and iii) the administration of transient immunosuppression including antagonistic anti-CD40 mAb, anti-CD20 mAb, rapamycin, and transient anti-inflammatory therapy including compstatin (e.g., the compstatin derivative APL-2), anti-IL-6 receptor mAb, and soluble TNF receptor.

Cells as disclosed throughout the application can be made into a tolerizing vaccine. For example, a tolerizing vaccine can be made of one or more transplanted cells disclosed herein. Alternatively, a tolerizing vaccine can be made of one or more cells that are different from any of the transplanted cells. For example, the cells made into a tolerizing vaccine can be genotypically and/or phenotypically different from any of the transplanted cells. However in some cases, the tolerizing vaccine will express NLRC5 (endogenously or exogenously). A tolerizing vaccine can promote survival of cells, organs, and/or tissues in transplantation. A tolerizing vaccine can be derived from non-human animals that are genotypically identical or similar to donor cells, organs, and/or tissues. For example, a tolerizing vaccine can be cells derived from pigs (e.g., apoptotic pig cells) that are genotypically identical or similar to donor pig cells, organs, and/or tissues. Subsequently, donor cells, organs, and/or tissues can be used in allografts or xenografts. In some cases, cells for a tolerizing vaccine can be from genetically modified animals (e.g., pigs) with reduced expression of GGTA1, CMAH, and B4GalNT2, and having transgenes encoding HLA-G (or HLA-E-), human CD47, human PD-L1 and human PD-L2. Graft donor animals can be generated by further genetically modifying the animals (e.g., pigs) for tolerizing vaccine cells. For example, graft donor animals can be generated by disrupting additional genes (e.g., NLRC5 (or TAP1), C3, and CXCL10) in the abovementioned animals for tolerizing vaccines cells (FIG. 5).

A tolerizing vaccine can comprise non-human animal cells (e.g., non-human mammalian cells). For example, non-human animal cells can be from a pig, a cat, a cattle, a deer, a dog, a ferret, a gaur, a goat, a horse, a mouse, a mouflon, a mule, a rabbit, a rat, a sheep, or a primate. Specifically, non-human animal cells can be porcine cells. A tolerizing vaccine can also comprise genetically modified non-human animal cells. For example, genetically modified non-human animal cells can be dead cells (e.g., apoptotic cells). A tolerizing vaccine can also comprise any genetically modified cells disclosed herein.

Treatment of Cells to Make a Tolerizing Vaccine

A tolerizing vaccine can comprise cells treated with a chemical. In some cases, the treatment can induce apoptosis of the cells. Without being bound by theory, the apoptotic cells can be picked up by host antigen presenting cells (e.g., in the spleen) and presented to host immune cells (e.g., T cells) in a non-immunogenic fashion that leads to induction of anergy in the immune cells (e.g., T cells).

Tolerizing vaccines can comprise apoptotic cells and non-apoptotic cells. An apoptotic cell in a tolerizing vaccine can be genetically identical to a non-apoptotic cell in the tolerizing vaccine. Alternatively, an apoptotic cell in a tolerizing vaccine can be genetically different from a non-apoptotic cell in the tolerizing vaccine. Tolerizing vaccines can comprise fixed cells and non-fixed cells. A fixed cell in a tolerizing vaccine can be genetically identical to a non-fixed cell in the tolerizing vaccine. Alternatively, a fixed cell in a tolerizing vaccine can be genetically different from a non-fixed cell in the tolerizing vaccine. In some cases, the fixed cell can be a 1-ethyl-3-(3-dimethylaminopropyl)-carbodiimide (ECDI)-fixed cell.

Cells in a tolerizing vaccine can be fixed using a chemical, e.g., ECDI. The fixation can make the cells apoptotic. A tolerizing vaccine, cells, kits and methods disclosed herein can comprise ECDI and/or ECDI treatment. For example, a tolerizing vaccine can be cells, e.g., the genetically modified cell as disclosed herein, that are treated with 1-ethyl-3-(3-dimethylaminopropyl)-carbodiimide (ECDI). In other words, the genetically modified cells as described throughout can be treated with ECDI to create a tolerizing vaccine. A tolerizing vaccine can then be used in transplantation to promote survival of cells, organs, and/or tissues that are transplanted. It is also contemplated that ECDI derivatives, functionalized ECDI, and/or substituted ECDI can also be used to treat the cells for a tolerizing vaccine. In some cases, cells for a tolerizing vaccine can be treated with any suitable carbodiimide derivatives, e.g., ECDI, N,N'-diisopropylcarbodiimide (DIC), N,N'-dicyclohexylcarbodiimide (DCC), and other carbodiimide derivatives understood by those in the art.

Cells for tolerizing vaccines can also be made apoptotic methods not involving incubation in the presence of ECDI, e.g., other chemicals or irradiation such as UV irradiation or gamma-irradiation.

ECDI can chemically cross-link free amine and carboxyl groups, and can effectively induce apoptosis in cells, organs, and/or tissues, e.g., from animal that gave rise to both a tolerizing vaccine and a donor non-human animal. In other words, the same genetically modified animal can give rise to a tolerizing vaccine and cells, tissues and/or organs that are used in transplantation. For example, the genetically modified cells as disclosed herein can be treated with ECDI. This ECDI fixation can lead to the creation of a tolerizing vaccine.

Genetically modified cells that can be used to make a tolerizing vaccine can be derived from: a spleen (including splenic B cells), liver, peripheral blood (including peripheral blood B cells), lymph nodes, thymus, bone marrow, or any combination thereof. For example, cells can be spleen cells, e.g., porcine spleen cells. In some cases, cells can be expanded ex-vivo. In some cases, cells can be derived from fetal, perinatal, neonatal, preweaning, and/or young adult, non-human animals. In some cases, cells can be derived from an embryo of a non-human animal.

Cells in a tolerizing vaccine can also comprise two or more disrupted (e.g., reduced expression) genes, where the two or more disrupted genes can be glycoprotein galactosyltransferase alpha 1,3 (GGTA1), putative cytidine monophosphate-N-acetylneuraminic acid hydroxylase-like protein (CMAH), HLA-E, HLA-G (e.g., HLA-G1, HLA-G2, HLA-G3, HLA-G4, HLA-G5, HLA-G6, or HLA-G7), B2M, and B4GALNT2, any functional fragments thereof, or any combination thereof. In some cases, the two or more disrupted genes does not include GGTA1. As described above, disruption can be a knockout or suppression of gene expression. Knockout can be performed by gene editing, for example, by using a CRISPR/cas system. Alternatively, suppression of gene expression can be done by knockdown, for example, using RNA interference, shRNA, one or more dominant negative transgenes. In some cases, cells can further comprise one or more transgenes as disclosed herein. For example, one or more transgenes can be CD46, CD55, CD59, or any combination thereof.

Cells in a tolerizing vaccine can also be derived from one or more donor non-human animals. In some cases, cells can be derived from the same donor non-human animal. Cells can be derived from one or more recipient non-human animals. In some cases, cells can be derived from two or more non-human animals (e.g., pig).

A tolerizing vaccine can comprise from or from about 0.001 and about 5.0, e.g., from or from about 0.001 and 1.0, endotoxin unit per kg bodyweight of a prospective recipient. For example, a tolerizing vaccine can comprise from or from about 0.01 to 5.0; 0.01 to 4.5; 0.01 to 4.0, 0.01 to 3.5; 0.01 to 3.0; 0.01 to 2.5; 0.01 to 2.0; 0.01 to 1.5; 0.01 to 1.0; 0.01 to 0.9; 0.01 to 0.8; 0.01 to 0.7; 0.01 to 0.6; 0.01 to 0.5; 0.01 to 0.4; 0.01 to 0.3; 0.01 to 0.2; or 0.01 to 0.1 endotoxin unit per kg bodyweight of a prospective recipient.

A tolerizing vaccine can comprise from or from about 1 to 100 aggregates, per µl. For example, a tolerizing vaccine can comprise from or from about 1 to 5; 1 to 10, or 1 to 20 aggregate per µl. A tolerizing vaccine can comprise at least or at least about 1, 5, 10, 20, 50, or 100 aggregates.

A tolerizing vaccine can trigger a release from or from about 0.001 pg/ml to 10.0 pg/ml, e.g., from or from about 0.001 pg/ml to 1.0 pg/ml, IL-1 beta when about 50,000 frozen to thawed human peripheral blood mononuclear cells are incubated with about 160,000 cells of the tolerizing vaccine (e.g., pig cells). For example, a tolerizing vaccine triggers a release of from or from about 0.001 to 10.0; 0.001 to 5.0; 0.001 to 1.0; 0.001 to 0.8; 0.001 to 0.2; or 0.001 to 0.1 pg/ml IL-1 beta when about 50,000 frozen to thawed human peripheral blood mononuclear cells are incubated with about 160,000 cell of the tolerizing vaccine (e.g., pig cells). A tolerizing vaccine can trigger a release of from or from about 0.001 to 2.0 pg/ml, e.g., from or from about 0.001 to 0.2 pg/ml, IL-6 when about 50,000 frozen to thawed human peripheral blood mononuclear cells are incubated with about 160,000 cells of the tolerizing vaccine (e.g., pig cells). For example, a tolerizing vaccine can trigger a release of from or from about 0.001 to 2.0; 0.001 to 1.0; 0.001 to 0.5; or 0.001 to 0.1 pg/ml IL-6 when about 50,000 frozen to thawed human peripheral blood mononuclear cells are incubated with about 160,000 cells of the tolerizing vaccine (e.g., pig cells).

A tolerizing vaccine can comprise more than or more than about 60%, e.g., more than or more than about 85%, Annexin V positive, apoptotic cells after a 4 hour or after about 4 hours post-release incubation at 37° C. For example, a tolerizing vaccine comprises more than 60%, 70%, 80%, 90%, or 99% Annexin V positive, apoptotic cells after about a 4 hour post-release incubation at 37° C.

A tolerizing vaccine can include from or from about 0.01% to 10%, e.g., from or from about 0.01% to 2%, necrotic cells. For example, a tolerizing vaccine includes from or from about 0.01% to 10%; 0.01% to 7.5%, 0.01% to 5%; 0.01% to 2.5%; or 0.01% to 1% necrotic cells.

Administering a tolerizing vaccine comprising ECDI-treated cells, organs, and/or tissues before, during, and/or after administration of donor cells can induce tolerance for cells, organs, and/or tissues in a recipient (e.g., a human or a non-human animal). ECDI-treated cells can be administered by intravenous infusion.

Tolerance induced by infusion of a tolerizing vaccine comprising ECDI-treated splenocytes is likely dependent on synergistic effects between an intact programmed death 1 receptor-programmed death ligand 1 signaling pathway and $CD4^+CD25^+Foxp3^+$ regulatory T cells.

Cells in a telorizing vaccine can be made into apoptotic cells (e.g., tolerizing vaccines) not only by ECDI fixation, but also through other methods. For example, any of the genetically modified cells as disclosed throughout, e.g., non-human cells animal cells or human cells (including stem cells), can be made apopototic by exposing the genetically modified cells to UV irradiation. The genetically modified cells can also be made apopototic by exposing it to gamma-irradiation. Other methods, not involving ECDI are also comtemplated, for example, by EtOH fixation.

Cells in a tolerizing vaccine, e.g., ECDI-treated cells, antigen-coupled cells, and/or epitope-coupled cells can comprise donor cells (e.g., cells from the donor of transplant grafts). Cells in a tolerizing vaccine, e.g., ECDI-treated cells, antigen-coupled cells, and/or epitope-coupled cells can comprise recipient cells (e.g., cells from the recipient of transplant grafts). Cells in a tolerizing vaccine, e.g., ECDI-treated cells, antigen-coupled cells, and/or epitope-coupled cells can comprise third party (e.g., neither donor nor recipient) cells. In some cases, third party cells are from a non-human animal of the same species as a recipient and/or donor. In other cases, third party cells are from a non-human animal of a different species as a recipient and/or donor.

ECDI-treatment of cells can be performed in the presence of one or more antigens and/or epitopes. ECDI-treated cells can comprise donor, recipient and/or third party cells. Likewise, antigens and/or epitopes can comprise donor, recipient and/or third party antigens and/or epitopes. In some cases, donor cells are coupled to recipient antigens and/or epitopes (e.g., ECDI-induced coupling). For example, soluble donor antigen derived from genetically engineered and genotypically identical donor cells (e.g., porcine cells) is coupled to recipient peripheral blood mononuclear cells with ECDI and the ECDI-coupled cells are administered via intravenous infusion.

In some cases, recipient cells are coupled to donor antigens and/or epitopes (e.g., ECDI-induced coupling). In some cases, recipient cells are coupled to third party antigens and/or epitopes (e.g., ECDI-induced coupling). In some cases, donor cells are coupled to recipient antigens and/or epitopes (e.g., ECDI-induced coupling). In some cases, donor cells are coupled to third party antigens and/or epitopes (e.g., ECDI-induced coupling). In some cases, third party cells are coupled to donor antigens and/or epitopes (e.g., ECDI-induced coupling). In some cases, third party cells are coupled to recipient antigens and/or epitopes (e.g., ECDI-induced coupling). For example, soluble donor antigen derived from genetically engineered and genotypically identical donor cells (e.g., porcine cells) is coupled to polystyrene nanoparticles with ECDI and the ECDI-coupled cells are administered via intravenous infusion.

Tolerogenic potency of any of these tolerizing cell vaccines can be further optimized by coupling to the surface of cells one or more of the following: IFN-g, NF-kB inhibitors (such as curcumin, triptolide, Bay-117085), vitamin D3, siCD40, cobalt protoporphyrin, insulin B9-23, or other immunomodulatory molecules that modify the function of host antigen-presenting cells and host lymphocytes.

These apoptotic cell vaccines can also be complemented by donor cells engineered to display on their surface molecules (such as FasL, PD-L1, galectin-9, CD8alpha) that trigger apoptotic death of donor-reactive cells.

Tolerizing vaccines disclosed herein can increase the duration of survival of a transplant (e.g., a xenograft or an allograft transplant) in a recipient. Tolerizing vaccines disclosed herein can also reduce or eliminate need for immunosuppression following transplantation. Xenograft or allograft transplant can be an organ, tissue, cell or cell line. Xenograft transplants and tolerizing vaccines can also be from different species. Alternatively, xenograft transplants and the tolerizing vaccines can be from the same species. For example, a xenograft transplant and a tolerizing vaccine can be from substantially genetically identical individuals (e.g., the same individual).

The ECDI fixed cells can be formulated into a pharmaceutical composition. For example, the ECDI fixed cells can be combined with a pharmaceutically acceptable excipient. An excipient that can be used is saline. An excipient that can be used is phosphate buffered saline (PBS). The pharmaceutical compositions can be then used to treat patients in need of transplantation.

Tolerizing Vaccines Made from Cells Derived Stem Cells

Cells for making tolerizing vaccines can be derived from stem cells. Such cells can include tolerizing apoptotic donor cells that are either stem cell-derived functional insulin-secreting islet β cells or other cells differentiated from the identical or genotypically similar stem cell line. These other cells can include leukocytes, lymphocytes, T lymphocytes, B lymphocytes, red blood cells, or any other donor cell.

These stem-cell derived tolerizing apoptotic donor cells need not be genetically engineered to lack functional expression of MHC class I. Functional expression of MHC class I on apoptotic donor cells can enhance their tolerogenic potential.

Stem cell-derived cells can be made apoptotic by UV irradiation, gamma-irradiation, or other methods not involving incubation in the presence of ECDI.

These negative cell vaccines can be infused intravenously pretransplant or both pretransplant and at intervals posttransplant, each under the cover of transient immunosuppression including but not limited to antagonistic anti-CD40 antibodies (e.g., humanized 2C10), B cell depleting or targeting antibodies (e.g., rituximab), mTOR inhibitors (e.g., rapamycin), and TNF-alpha inhibitors (e.g., sTNFR, including etanercept), and IL-6 inhibitors (e.g., anti-IL-6R antibody, including tocilizumab).

Tolerogenic potency of any of these tolerizing cell vaccines can be further optimized by coupling to the surface of cells one or more of the following molecules: IFN-g, NF-kB inhibitors (such as curcumin, triptolide, Bay-117085), vitamin D3, siCD40, cobalt protoporphyrin, insulin B9-23, or other immunomodulatory molecules that modify the function of host antigen-presenting cells and host lymphocytes.

These apoptotic cell vaccines can also be complemented by donor cells engineered to display on their surface molecules (such as FasL, PD-L1, galectin-9, CD8alpha) that trigger apoptotic death of donor-reactive cells.

As with human stem cell derived tolerizing vaccines, tolerizing apoptotic donor pig vaccines can be derived from the same cell sources, can express MHC class I antigen, made apoptotic using the same methods, optimized by by coupling to the surface of cells one or more immunomodulatory molecules, and infused intravenously pretransplant or both pretransplant and at intervals posttransplant under the cover of concomitant immunotherapy.

IV. Method of Making Genetically Modified Non-Human Animals

In order to make a genetically modified non-human animal as described above, various techniques can be used. Disclosed herein are a few examples to create genetically modified animals. It is to be understood that the methods disclosed herein are simply examples, and are not meant to limiting in any way.

Gene Disruption

Gene disruption can be performed by any methods described above, for example, by knockout, knockdown, RNA interference, dominant negative, etc. A detailed description of the methods are disclosed above in the section regarding genetically modified non-human animals.

CRISPR/Cas System

Methods described herein can take advantage of a CRISPR/cas system. For example, double-strand breaks (DSBs) can be generated using a CRISPR/cas system, e.g., a type II CRISPR/cas system. A Cas enzyme used in the methods disclosed herein can be Cas9, which catalyzes DNA cleavage. Enzymatic action by Cas9 derived from *Streptococcus pyogenes* or any closely related Cas9 can generate double stranded breaks at target site sequences which hybridize to 20 nucleotides of a guide sequence and that have a protospacer-adjacent motif (PAM) following the 20 nucleotides of the target sequence.

A vector can be operably linked to an enzyme-coding sequence encoding a CRISPR enzyme, such as a Cas protein. Non-limiting examples of Cas proteins include Cas1, Cas1B, Cas2, Cas3, Cas4, Cas5, Cas5d, Cas5t, Cas5h, Cas5a, Cash, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, homologues thereof, or modified versions thereof. An unmodified CRISPR enzyme can have DNA cleavage activity, such as Cas9. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence. A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the ammo-terminus, about or more than about 1, 2, 3, 4, 5, 6, 7, 8, 9, 10 NLSs at or near the carboxy-terminus, or any combination of these (e.g., one or more NLS at the ammo-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise at most 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Guide RNA

As used herein, the term "guide RNA" and its grammatical equivalents can refer to an RNA which can be specific for a target DNA and can form a complex with Cas protein. An RNA/Cas complex can assist in "guiding" Cas protein to a target DNA.

A method disclosed herein also can comprise introducing into a cell or embryo at least one guide RNA or nucleic acid, e.g., DNA encoding at least one guide RNA. A guide RNA can interact with a RNA-guided endonuclease to direct the endonuclease to a specific target site, at which site the 5' end of the guide RNA base pairs with a specific protospacer sequence in a chromosomal sequence.

A guide RNA can comprise two RNAs, e.g., CRISPR RNA (crRNA) and transactivating crRNA (tracrRNA). A guide RNA can sometimes comprise a single-chain RNA, or single guide RNA (sgRNA) formed by fusion of a portion (e.g., a functional portion) of crRNA and tracrRNA. A guide RNA can also be a dual RNA comprising a crRNA and a tracrRNA. Furthermore, a crRNA can hybridize with a target DNA.

As discussed above, a guide RNA can be an expression product. For example, a DNA that encodes a guide RNA can be a vector comprising a sequence coding for the guide RNA. A guide RNA can be transferred into a cell or organism by transfecting the cell or organism with an isolated guide RNA or plasmid DNA comprising a sequence coding for the guide RNA and a promoter. A guide RNA can also be transferred into a cell or organism in other way, such as using virus-mediated gene delivery.

A guide RNA can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA can be complementary to sequence at a target site in a chromosomal sequence such that the first region of the guide RNA can base pair with the target site. In some cases, a first region of a guide RNA can comprise from or from about 10 nucleotides to 25 nucleotides (i.e., from 10 nts to 25 nts; or from about 10 nts to about 25 nts; or from 10 nts to about 25 nts; or from about 10 nts to 25 nts) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA can also comprises a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA can be introduced into a cell or embryo as an RNA molecule. For example, a RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III). Plasmid vectors that can be used to express guide RNA include, but are not limited to, px330 vectors and px333 vectors. In some cases, a plasmid vector (e.g., px333 vector) can comprise two guide RNA-encoding DNA sequences.

A DNA sequence encoding a guide RNA can also be part of a vector. Further, a vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like. A DNA molecule encoding a guide RNA can also be linear. A DNA molecule encoding a guide RNA can also be circular.

When DNA sequences encoding an RNA-guided endonuclease and a guide RNA are introduced into a cell, each DNA sequence can be part of a separate molecule (e.g., one vector containing an RNA-guided endonuclease coding sequence and a second vector containing a guide RNA coding sequence) or both can be part of a same molecule (e.g., one vector containing coding (and regulatory) sequence for both an RNA-guided endonuclease and a guide RNA).

Guide RNA can target a gene in a pig or a pig cell. In some cases, guide RNA can target a pig NLRC5 gene, e.g., sequences listed in Table 4. In some cases, guide RNA can be designed to target pig NLRC5, GGTA1 or CMAH gene. Exemplary oligonucleotides for making the guide RNA are listed in Table 5.

TABLE 4

Exemplary Sequences of the NLRC5 gene to be targeted by guide RNAs

| SEQ ID No. | Sequence (5'-3') |
| --- | --- |
| 61 | ggggaggaagaacttcacct |
| 62 | gtaggacgaccctctgtgtg |
| 63 | gaccctctgtgtggggtctg |
| 64 | ggctcggttccattgcaaga |
| 65 | gctcggttccattgcaagat |
| 66 | ggttccattgcaagatgggc |
| 67 | gtccctcctgagtgtcgaa |
| 68 | gcctcaggtacagatcaaaa |
| 69 | ggacctgggtgccaggaacg |
| 70 | gtacccagagtcagatcacc |
| 71 | gtacccagagtcagatcacc |
| 72 | gtgcccttcgacactcagga |
| 73 | gtgcccttcgacactcagga |
| 74 | gtgcccttcgacactcagga |
| 75 | gggggccccaaggcagaaga |
| 76 | ggcagtcttccagtacctgg |

TABLE 5

Exemplary oligonucleotides for making guide RNA constructs

| Gene | SEQ ID No. | Forward sequence (5' to 3') | SEQ ID No. | Reverse sequence (5' to 3') |
| --- | --- | --- | --- | --- |
| NLRC5 | 77 | acaccggggaggaagaacttcacctg | 78 | aaaacaggtgaagttcttcctccccg |
| NLRC5 | 79 | acaccgtaggacgaccctctgtgtgg | 80 | aaaaccacacagagggtcgtcctacg |
| NLRC5 | 81 | acaccgaccctctgtgtggggtctgg | 82 | aaaaccagaccccacacagagggtcg |
| NLRC5 | 83 | acaccggctcggttccattgcaagag | 84 | aaaactcttgcaatggaaccgagccg |
| NLRC5 | 85 | acaccgctcggttccattgcaagatg | 86 | aaaacatcttgcaatggaaccgagcg |
| NLRC5 | 87 | acaccggttccattgcaagatgggcg | 88 | aaaacgcccatcttgcaatggaaccg |
| NLRC5 | 89 | acaccgtccctcctgagtgtcgaag | 90 | aaaacttcgacactcaggaggggacg |
| NLRC5 | 91 | acaccgcctcaggtacagatcaaaag | 92 | aaaacttttgatctgtacctgaggcg |
| NLRC5 | 93 | acaccggacctgggtgccaggaacgg | 94 | aaaaccgttcctggcacccaggtccg |
| NLRC5 | 95 | acaccgtacccagagtcagatcaccg | 96 | aaaacggtgatctgactctgggtacg |

TABLE 5-continued

Exemplary oligonucleotides for making guide RNA constructs

| Gene | SEQ ID No. | Forward sequence (5' to 3') | SEQ ID No. | Reverse sequence (5' to 3') |
|---|---|---|---|---|
| NLRC5 | 97 | acaccgtacccagagtcagatcaccg | 98 | aaaacggtgatctgactctgggtacg |
| NLRC5 | 99 | acaccgtgcccttcgacactcaggag | 100 | aaaactcctgagtgtcgaagggcacg |
| NLRC5 | 101 | acaccgtgcccttcgacactcaggag | 102 | aaaactcctgagtgtcgaagggcacg |
| NLRC5 | 103 | acaccgtgcccttcgacactcaggag | 104 | aaaactcctgagtgtcgaagggcacg |
| NLRC5 | 105 | acaccgggggccccaaggcagaagag | 106 | aaaactcttctgccttggggcccccg |
| NLRC5 | 107 | acaccggcagtcttccagtacctggg | 108 | aaaacccaggtactggaagactgccg |
| GGTA1 | 109 | caccgagaaaataatgaatgtcaa | 110 | aaacttgacattcattattttctc |
| CMAH | 111 | caccgagtaaggtacgtgatctgt | 112 | aaacacagatcacgtaccttactc |

Homologous Recombination

Homologous recombination can also be used for any of the relevant genetic modifications as disclosed herein. Homologous recombination can permit site-specific modifications in endogenous genes and thus novel modifications can be engineered into a genome. For example, the ability of homologous recombination (gene conversion and classical strand breakage/rejoining) to transfer genetic sequence information between DNA molecules can render targeted homologous recombination and can be a powerful method in genetic engineering and gene manipulation.

Cells that have undergone homologous recombination can be identified by a number of methods. For example, a selection method can detect an absence of an immune response against a cell, for example by a human anti-gal antibody. A selection method can also include assessing a level of clotting in human blood when exposed to a cell or tissue. Selection via antibiotic resistance can be used for screening.

Making Transgenic Non-Human Animals

Random Insertion

One or more transgenes of the methods described herein can be inserted randomly to any locus in a genome of a cell. These transgenes can be functional if inserted anywhere in a genome. For instance, a transgene can encode its own promoter or can be inserted into a position where it is under the control of an endogenous promoter. Alternatively, a transgene can be inserted into a gene, such as an intron of a gene or an exon of a gene, a promoter, or a non-coding region.

A DNA encoding a transgene sequences can be randomly inserted into a chromosome of a cell. A random integration can result from any method of introducing DNA into a cell known to one of skill in the art. This can include, but is not limited to, electroporation, sonoporation, use of a gene gun, lipotransfection, calcium phosphate transfection, use of dendrimers, microinjection, use of viral vectors including adenoviral, AAV, and retroviral vectors, and/or group II ribozymes.

A DNA encoding a transgene can also be designed to include a reporter gene so that the presence of the transgene or its expression product can be detected via activation of the reporter gene. Any reporter gene known in the art can be used, such as those disclosed above. By selecting in cell culture those cells in which a reporter gene has been activated, cells can be selected that contain a transgene.

A DNA encoding a transgene can be introduced into a cell via electroporation. A DNA can also be introduced into a cell via lipofection, infection, or transformation. Electroporation and/or lipofection can be used to transfect fibroblast cells.

Expression of a transgene can be verified by an expression assay, for example, qPCR or by measuring levels of RNA. Expression level can be indicative also of copy number. For example, if expression levels are extremely high, this can indicate that more than one copy of a transgene was integrated in a genome. Alternatively, high expression can indicate that a transgene was integrated in a highly transcribed area, for example, near a highly expressed promoter. Expression can also be verified by measuring protein levels, such as through Western blotting.

Site Specific Insertion

Inserting one or more transgenes in any of the methods disclosed herein can be site-specific. For example, one or more transgenes can be inserted adjacent to a promoter, for example, adjacent to or near a Rosa26 promoter.

Modification of a targeted locus of a cell can be produced by introducing DNA into cells, where the DNA has homology to the target locus. DNA can include a marker gene, allowing for selection of cells comprising the integrated construct. Homologous DNA in a target vector can recombine with a chromosomal DNA at a target locus. A marker gene can be flanked on both sides by homologous DNA sequences, a 3' recombination arm, and a 5' recombination arm.

A variety of enzymes can catalyze insertion of foreign DNA into a host genome. For example, site-specific recombinases can be clustered into two protein families with distinct biochemical properties, namely tyrosine recombinases (in which DNA is covalently attached to a tyrosine residue) and serine recombinases (where covalent attachment occurs at a serine residue). In some cases, recombinases can comprise Cre, fC31 integrase (a serine recombinase derived from *Streptomyces* phage fC31), or bacteriophage derived site-specific recombinases (including Flp, lambda integrase, bacteriophage HK022 recombinase, bacteriophage R4 integrase and phage TP901-1 integrase).

Expression control sequences can also be used in constructs. For example, an expression control sequence can comprise a constitutive promoter, which is expressed in a wide variety of cell types. For example, among suitable strong constitutive promoters and/or enhancers are expression control sequences from DNA viruses (e.g., SV40, polyoma virus, adenoviruses, adeno-associated virus, pox viruses, CMV, HSV, etc.) or from retroviral LTRs. Tissue-specific promoters can also be used and can be used to direct expression to specific cell lineages. While experiments discussed in the Examples below will be conducted using a Rosa26 gene promoter, other Rosa26-related promoters capable of directing gene expression can be used to yield similar results, as will be evident to those of skill in the art. Therefore, the description herein is not meant to be limiting, but rather disclose one of many possible examples. In some cases, a shorter Rosa26 5'-upstream sequences, which can nevertheless achieve the same degree of expression, can be used. Also useful are minor DNA sequence variants of a Rosa26 promoter, such as point mutations, partial deletions or chemical modifications.

A Rosa26 promoter is expressible in mammals. For example, sequences that are similar to the 5' flanking sequence of a pig Rosa26 gene, including, but not limited to, promoters of Rosa26 homologues of other species (such as human, cattle, mouse, sheep, goat, rabbit and rat), can also be used. A Rosa26 gene can be sufficiently conserved among different mammalian species and other mammalian Rosa26 promoters can also be used.

The CRISPR/Cas system can be used to perform site specific insertion. For example, a nick on an insertion site in the genome can be made by CRISPR/cas to facilitate the insertion of a transgene at the insertion site.

The methods described herein, can utilize techniques which can be used to allow a DNA or RNA construct entry into a host cell include, but are not limited to, calcium phosphate/DNA coprecipitation, microinjection of DNA into a nucleus, electroporation, bacterial protoplast fusion with intact cells, transfection, lipofection, infection, particle bombardment, sperm mediated gene transfer, or any other technique known by one skilled in the art.

Certain aspects disclosed herein can utilize vectors. Any plasmids and vectors can be used as long as they are replicable and viable in a selected host. Vectors known in the art and those commercially available (and variants or derivatives thereof) can be engineered to include one or more recombination sites for use in the methods. Vectors that can be used include, but not limited to eukaryotic expression vectors such as pFastBac, pFastBacHT, pFastBacDUAL, pSFV, and pTet-Splice (Invitrogen), pEUK-C1, pPUR, pMAM, pMAMneo, pBI101, pBI121, pDR2, pCMVEBNA, and pYACneo (Clontech), pSVK3, pSVL, pMSG, pCH110, and pKK232-8 (Pharmacia, Inc.), p3'SS, pXT1, pSG5, pPbac, pMbac, pMClneo, and pOG44 (Stratagene, Inc.), and pYES2, pAC360, pBlueBa-cHis A, B, and C, pVL1392, pBlueBac111, pCDM8, pcDNA1, pZeoSV, pcDNA3, pREP4, pCEP4, and pEBVHis (Invitrogen, Corp.), and variants or derivatives thereof.

These vectors can be used to express a gene, e.g., a transgene, or portion of a gene of interest. A gene of portion or a gene can be inserted by using known methods, such as restriction enzyme-based techniques.

Making Genetically Modified Non-Human Animals Using a Zygote

Making a genetically modified non-human animal using a nucleic acid from another genetically modified non-human animal can be done using various techniques known in the art, for example, such as by zygote manipulation.

For example, zygotes can be used to make a similar genetically modified non-human animal. A method of making similar genetically modified non-human animals comprising a) producing a cell with reduced expression of one or more genes and/or comprise exogenous polynucleotides disclosed herein, b) generating an embryo using the resulting cell of a); and c) growing the embryo into the genetically modified non-human animal. The cell of a) can be produced by disrupting (e.g., reducing expression) one or more genes in the cell (e.g., as described above in a genetically modified non-human animals).

This method can be used to make a similar genetically modified non-human animal disclosed herein. For example, a method of making a genetically modified non-human animal can comprise: a) producing a cell with reduced expression of one or more genes disclosed herein e.g. (as disclosed above), where the one or more genes comprise NLRC5, TAP1, and/or C3; b) generating an embryo from the resulting cell of a); and c) growing the embryo into the genetically modified non-human animal.

Cells used in this method can be from any disclosed genetically modified cells as described herein. For example, disrupted genes are not limited to NRLC5, TAP1, and/or C3. Other combinations of gene disruptions and transgenes can be found throughout the disclosure herein. Furthermore, a genetically modified cell can be of any origin, such as from a non-human animal (as described herein) or genetically modified cells (as described herein).

A cell of a) in the methods disclosed herein can be a zygote (e.g., a cell formed by joining of a sperm and an ovum). A zygote can be formed by joining: i) of a sperm of a wild-type non-human animal and an ovum of a wild-type non-human animal; ii) a sperm of a wild-type non-human animal and an ovum of a genetically modified non-human animal; iii) a sperm of a genetically modified non-human animal and an ovum of a wild-type non-human animal; and/or iv) a sperm of a genetically modified non-human animal and an ovum of a genetically modified non-human animal. A non-human animal can be a pig.

One or more genes in a cell of a) in the methods disclosed herein can be disrupted by generating breaks at desired locations in a genome). For example, breaks can be double-stranded breaks (DSBs). DSBs can be generated using a nuclease comprising Cas (e.g., Cas9), ZFN, TALEN, and maganuclease. Nuclease can be a naturally-existing or a modified nuclease. A nucleic acid encoding a nuclease can also be delivered to a cell, where the nuclease is expressed.

Following DSBs, one or more genes can be disrupted by DNA repairing mechanisms, such as homologous recombination (HR) and/or nonhomologous end-joining (NHEJ).

A method can comprise inserting one or more transgenes to a genome of the cell of a). One or more transgenes can comprise ICP47, CD46, CD55, CD59, HLA-E, HLA-G (e.g., HLA-G1, HLA-G2, HLA-G3, HLA-G4, HLA-G5, HLA-G6, or HLA-G7), B2M, any functional fragments thereof, and/or any combination thereof.

A method provided herein can comprise inserting one or more transgenes where one or more transgenes can be any transgene in any non-human animal or genetically modified cell disclosed herein. Transgenes can be inserted into a genome of a non-human animal or genetically modified cell in a random or targeted manner, as described herein.

Transgenes can also be inserted to a specific locus in a genome of a non-human animal or genetically modified cell, as disclosed herein. For example, a transgene can be inserted adjacent to a promoter. A transgene can be inserted near a promoter that can be at least or at least about 1, 10, 50, 100, 500, or 1000 base pairs from a promoter. A gene in some cases and be inserted into a different chromosome and can still be control by a promoter. Transgenes can also be inserted at the 3' region of the sense strand from a promoter (e.g., downstream of a promoter). Alternatively, transgenes can be inserted at the 5' region of the sense strand from a promoter (e.g., upstream of a promoter). Transgenes can be inserted adjacent to a porcine promoter. For example, transgenes can be inserted adjacent to porcine Rosa26 promoter.

A promoter that can be used herein are described throughout the application. For example, a promoter that can be used in methods can be a ubiquitous, tissue-specific or an inducible promoter. Expression of a transgene that is inserted adjacent to a promoter can be regulated. For example, if a transgene is inserted near or next to a ubiquitous promoter, the transgene will be expressed in all cells of a non-human animal. Some ubiquitous promoters can be a CAGGS promoter, an hCMV promoter, a PGK promoter, an SV40 promoter, or a Rosa26 promoter.

A promoter can be homologous to a promoter sequence present within the genome of a human or a non-human animal, such as pig, human, cattle, sheep, goat, rabbit, mouse or rat. A promoter can exhibit at least or at least about 50%, 60%, 70%, 80, 90%, 95%, 96%, 97%, 98%, or 99% homology to a promoter sequence present within the genome of a human or a non-human animal. A promoter can exhibit 100% homology to a promoter sequence present within the genome of a human or a non-human animal. A promoter can also exhibit at least or at least about 50%, 60%, 70%, 80, 90%, 95%, 96%, 97%, 98%, or 99% identity to a promoter sequence present within the genome of a human or a non-human animal. A promoter can also exhibit at 100% identity to a promoter sequence present within the genome of a human or a non-human animal.

Making a Similar Genetically Modified Non-Human Animal Using Cell Nuclear Transfer An alternative method of making a genetically modified non-human animal can be by cell nuclear transfer. A method of making genetically modified non-human animals can comprise a) producing a cell with reduced expression of one or more genes and/or comprise exogenous polynucleotides disclosed herein; b) providing a second cell and transferring a nucleus of the resulting cell from a) to the second cell to generate an embryo generating an embryo; c) growing the embryo into the genetically modified non-human animal. A cell in this method can be an enucleated cell. The cell of a) can be made using any methods, e.g., gene disruption and/or insertion described herein or known in the art.

This method can be used to make a similar genetically modified non-human animal disclosed herein. For example, a method of making a genetically modified non-human animal can comprise: a) producing a cell with reduced expression of NLRC5, TAP1 and/or C3; b) providing a second cell and transferring a nucleus of the resulting cell from a) to the second cell to generate an embryo; and c) growing the embryo to the genetically modified non-human animal. A cell in this method can be an enucleated cell.

Cells used in this method can be from any disclosed genetically modified cells as described herein. For example, disrupted genes are not limited to NRLC5, TAP1, and/or C3. Other combinations of gene disruptions and transgenes can be found throughout disclosure herein. For example, a method can comprise providing a first cell from any non-human animal disclosed herein; providing a second cell; transferring a nucleus of the first cell of a) to the second cell of b); generating an embryo from the product of c); and growing the embryo to the genetically modified non-human animal.

A cell of a) in the methods disclosed herein can be a zygote. The zygote can be formed by joining: i) of a sperm of a wild-type non-human animal and an ovum of a wild-type non-human animal; ii) a sperm of a wild-type non-human animal and an ovum of a genetically modified non-human animal; iii) a sperm of a genetically modified non-human animal and an ovum of a wild-type non-human animal; and/or iv) a sperm of a genetically modified non-human animal and an ovum of a genetically modified non-human animal. A non-human animal can be a pig.

One or more genes in a cell of a) in the methods disclosed herein can be disrupted by generating breaks at desired locations in the genome. For example, breaks can be double-stranded breaks (DSBs). DSBs can be generated using a nuclease comprising Cas (e.g., Cas9), ZFN, TALEN, and maganuclease. Nuclease can be a naturally-existing or a modified nuclease. A nucleic acid encoding a nuclease can be delivered to a cell, where the nuclease is expressed. Cas9 and guide RNA targeting a gene in a cell can be delivered to the cell. In some cases, mRNA molecules encoding Cas9 and guide RNA can be injected into a cell. In some cases, a plasmid encoding Cas9 and a different plasmid encoding guide RNA can be delivered into a cell (e.g., by infection). In some cases, a plasmid encoding both Cas9 and guide RNA can be delivered into a cell (e.g., by infection).

As described above, following DSBs, one or more genes can be disrupted by DNA repairing mechanisms, such as homologous recombination (HR) and/or nonhomologous end-joining (NHEJ). A method can comprise inserting one or more transgenes to a genome of the cell of a). One or more transgenes can comprise ICP47, CD46, CD55, CD59, HLA-E, HLA-G (e.g., HLA-G1, HLA-G2, HLA-G3, HLA-G4, HLA-G5, HLA-G6, or HLA-G7), B2M, any functional fragments thereof, and/or any combination thereof.

The methods provided herein can comprise inserting one or more transgenes where the one or more transgenes can be any transgene in any non-human animal or genetically modified cell disclosed herein.

Also disclosed herein are methods of making a non-human animal using a cell from a genetically modified non-human animal. A cell can be from any genetically modified non-human animal disclosed herein. A method can comprise: a) providing a cell from a genetically identified non-human animal; b) providing a cell; c) transferring a nucleus of the cell of a) to the cell of b); c) generating an embryo from the product of c); and d) growing the embryo to the genetically modified non-human animal. A cell of this method can be an enucleated cell.

Further, cells of a) in the methods can be any cell from a genetically modified non-human animal. For example, a cell of a) in methods disclosed herein can be a somatic cell, such as a fibroblast cell or a fetal fibroblast cell.

An enucleated cell in the methods can be any cell from an organism. For example, an enucleated cell is a porcine cell. An enucleated cell can be an ovum, for example, an enucleated unfertilized ovum.

Genetically modified non-human animal disclosed herein can be made using any suitable techniques known in the art. For example, these techniques include, but are not limited to, microinjection (e.g., of pronuclei), sperm-mediated gene transfer, electroporation of ova or zygotes, and/or nuclear transplantation.

A method of making similar genetically modified non-human animals can comprise a) disrupting one or more genes in a cell, b) generating an embryo using the resulting cell of a); and c) growing the embryo into the genetically modified non-human animal.

A cell of a) in the methods disclosed herein can be a somatic cell. There is no limitation on a type or source of a somatic cell. For example, it can be from a pig or from cultured cell lines or any other viable cell. A cell can also be a dermal cell, a nerve cell, a cumulus cell, an oviduct epithelial cell, a fibroblast cell (e.g., a fetal fibroblast cell), or hepatocyte. A cell of a) in the methods disclosed herein can be from a wild-type non-human animal, a genetically modified non-human animal, or a genetically modified cell. Furthermore, a cell of b) can be an enucleated ovum (e.g., an enucleated unfertilized ovum).

Enucleation can also be performed by known methods. For example, metaphase II oocytes can be placed in either HECM, optionally containing or containing about 7-10 micrograms per milliliter cytochalasin B, for immediate enucleation, or can be placed in a suitable medium (e.g., an embryo culture medium such as CR1aa, plus 10% estrus cow serum), and then enucleated later (e.g., not more than 24 hours later or 16-18 hours later). Enucleation can also be accomplished microsurgically using a micropipette to remove the polar body and the adjacent cytoplasm. Oocytes can then be screened to identify those of which have been successfully enucleated. One way to screen oocytes can be to stain the oocytes with or with about 3-10 microgram per milliliter 33342 Hoechst dye in suitable holding medium, and then view the oocytes under ultraviolet irradiation for less than 10 seconds. Oocytes that have been successfully enucleated can then be placed in a suitable culture medium, for example, CR1aa plus 10% serum. The handling of oocytes can also be optimized for nuclear transfer.

The embryos generated herein can be transferred to surrogate non-human animals (e.g., pigs) to produce offspring (e.g., piglets). For example, the embryos can be transferred to the oviduct of recipient gilts on the day or 1 day after estrus e.g., following mid-line laparotomy under general anesthesia. Pregnancy can be diagnosed, e.g., by ultrasound. Pregnancy can be diagnosed after or after about 28 days from the transfer. The pregnancy can then checked at or at about 2-week intervals by ultrasound examination. All of the microinjected offspring (e.g., piglets) can be delivered by natural birth. Information of the pregnancy and delivery (e.g., time of pregnancy, rates of pregnancy, number of offspring, survival rate, etc.) can be documented. The genotypes and phenotypes of the offspring can be measured using any methods described through the application such as sequencing (e.g., next-generation sequencing).

Cultured cells can be used immediately for nuclear transfer (e.g., somatic cell nuclear transfer), embryo transfer, and/or inducing pregnancy, allowing embryos derived from healthy stable genetic modifications give rise to offspring (e.g., piglets). Such approach can reduce time and cost, e.g., months of costly cell screening that may result in genetically modified cells fail to produce healthy piglets.

Embryo growing and transferring can be performed using standard procedures used in the embryo growing and transfer industry. For example, surrogate mothers can be used. Embryos can also be grown and transferred in culture, for example, by using incubators. In some cases, an embryo can be transferred to an animal, e.g., a surrogate animal, to establish a pregnancy.

It can be desirable to replicate or generate a plurality of genetically modified non-human animals that have identical genotypes and/or phenotypes disclosed herein. For example, a genetically modified non-human animal can be replicated by breeding (e.g., selective breading). A genetically modified non-human animal can be replicated by nuclear transfer (e.g., somatic cell nuclear transfer) or introduction of DNA into a cell (e.g., oocytes, sperm, zygotes or embryonic stem cells). These methods can be reproduced a plurality of times to replicate or generate a plurality of a genetically modified non-human animal disclosed herein. In some cases, cells can be isolated from the fetuses of a pregnant genetically modified non-human animal. The isolated cells (e.g., fetal cells) can be used for generating a plurality of genetically modified non-human animals similar or identical to the pregnant animal. For example, the isolated fetal cells can provide donor nuclei for generating genetically modified animals by nuclear transfer, (e.g., somatic cell nuclear transfer).

V. Methods of Use

Cells, organs, and/or tissues can be extracted from a non-human animal as described herein. Cells, organs, and/or tissues can be genetically altered ex vivo and used accordingly. These cells, organs, and/or tissues can be used for cell-based therapies. These cells, organs, and/or tissues can be used to treat or prevent disease in a recipient (e.g., a human or non-human animal). Surprisingly, the genetic modifications as described herein can help prevent rejection. Additionally, cells, organs, and/or tissues can be made into tolerizing vaccines to also help tolerize the immune system to transplantation. Further, tolerizing vaccines can temper the immune system, including, abrogating autoimmune responses.

Disclosed herein are methods for treating a disease in a subject in need thereof can comprise administering a tolerizing vaccine to the subject; administering a pharmaceutical agent that inhibits T cell activation to the subject; and transplanting a genetically modified cell to the subject. The pharmaceutical agent that inhibits T cell activation can be an antibody. The antibody can be an anti-CD40 antibody disclosed herein. The cell transplanted to the subject can be any genetically modified cell described throughout the application. The tissue or organ transplanted to the subject can comprise one or more of the genetically modified cells. In some cases, the methods can further comprise administering one or more immunosuppression agent described in the application, such as further comprising providing to the recipient one or more of a B-cell depleting antibody, an mTOR inhibitor, a TNF-alpha inhibitor, a IL-6 inhibitor, a nitrogen mustard alkylating agent (e.g., cyclophosphamide), and a complement C3 or C5 inhibitor.

Also disclosed herein are methods for treating a disease, comprising transplanting one or more cells to a subject in need thereof. The one or more cells can be any genetically modified cells disclosed herein. In some cases, the methods can comprise transplanting a tissue or organ comprising the one or more cells (e.g., genetically modified cells) to the subject in need thereof.

Described herein are methods of treating or preventing a disease in a recipient (e.g., a human or non-human animal) comprising transplanting to the recipient (e.g., a human or non-human animal) one or more cells (including organs and/or tissues) derived from a genetically modified non-human animal comprising one or more genes with reduced expression. One or more cells can be derived from a genetically modified non-human animal as described throughout.

The methods disclosed herein can be used for treating or preventing disease including, but not limited to, diabetes, cardiovascular diseases, lung diseases, liver diseases, skin diseases, or neurological disorders. For example, the methods can be used for treating or preventing Parkinson's disease or Alzheimer's disease. The methods can also be used for treating or preventing diabetes, including type 1, type 2, cystic fibrosis related, surgical diabetes, gestational diabetes, mitochondrial diabetes, or combination thereof. In some cases, the methods can be used for treating or preventing hereditary diabetes or a form of hereditary diabetes.

Further, the methods can be used for treating or preventing type 1 diabetes. The methods can also be used for treating or preventing type 2 diabetes. The methods can be used for treating or preventing pre-diabetes.

For example, when treating diabetes, genetically modified splenocytes can be fixed with ECDI and given to a recipient. Further, genetically modified pancreatic islet cells can be grafted into the same recipient to produce insulin. Genetically modified splenocytes and pancreatic islet cells can be genetically identical and can also be derived from the same genetically modified non-human animal.

Provided herein include i) genetically modified cells, tissues or organs for use in administering to a subject in need thereof to treat a condition in the subject; ii) a tolerizing vaccine for use in immunotolerizing the subject to a graft, where the tolerizing vaccine comprise a genetically modified cell, tissue, or organ; iii) one or more pharmaceutical agents for use in inhibiting T cell activation, B cell activation, dendritic cell activation, or a combination thereof in the subject; or iv) any combination thereof.

Also provided herein include genetically modified cells, tissues or organs for use in administering to a subject in need thereof to treat a condition in the subject. The subject can have been or become tolerized to the genetically modified cell, tissue or organ by use of a tolerizing vaccine. Further, the subject can be administered one or more pharmaceutical agents that inhibit T cell activation, B cell activation, dendritic cell activation, or a combination thereof.

Transplantation

The methods disclosed herein can comprise transplanting. Transplanting can be autotransplanting, allotransplanting, xenotransplanting, or any other transplanting. For example, transplanting can be xenotransplanting. Transplanting can also be allotransplanting.

"Xenotransplantation" and its grammatical equivalents as used herein can encompass any procedure that involves transplantation, implantation, or infusion of cells, tissues, or organs into a recipient, where the recipient and donor are different species. Transplantation of the cells, organs, and/or tissues described herein can be used for xenotransplantation in into humans. Xenotransplantation includes but is not limited to vascularized xenotransplant, partially vascularized xenotransplant, unvascularized xenotransplant, xenodressings, xenobandages, and xenostructures.

"Allotransplantation" and its grammatical equivalents as used herein can encompasses any procedure that involves transplantation, implantation, or infusion of cells, tissues, or organs into a recipient, where the recipient and donor are the same species. Transplantation of the cells, organs, and/or tissues described herein can be used for allotransplantation in into humans. Allotransplantation includes but is not limited to vascularized allotransplant, partially vascularized allotransplant, unvascularized allotransplant, allodressings, allobandages, and allostructures.

After treatment (e.g., any of the treatment as disclosed herein), transplant rejection can be improved as compared to when one or more wild-type cells is transplanted into a recipient. For example, transplant rejection can be hyperacute rejection. Transplant rejection can also be acute rejection. Other types of rejection can include chronic rejection. Transplant rejection can also be cell-mediated rejection or T cell-mediated rejection. Transplant rejection can also be natural killer cell-mediated rejection.

"Improving" and its grammatical equivalents as used herein can mean any improvement recognized by one of skill in the art. For example, improving transplantation can mean lessening hyperacute rejection, which can encompass a decrease, lessening, or diminishing of an undesirable effect or symptom.

The disclosure describes methods of treatment or preventing diabetes or prediabetes. For example, the methods include but are not limited to, administering one or more pancreatic islet cell(s) from a donor non-human animal described herein to a recipient, or a recipient in need thereof. The methods can be transplantation or, in some cases, xenotransplantation. The donor animal can be a non-human animal. A recipient can be a primate, for example, a non-human primate including, but not limited to, a monkey. A recipient can be a human and in some cases, a human with diabetes or pre-diabetes. In some cases, whether a patient with diabetes or pre-diabetes can be treated with transplantation can be determined using an algorithm, e.g., as described in *Diabetes Care* 2015; 38:1016-1029, which is incorporated herein by reference in its entirety.

The methods can also include methods of xenotransplantation where the transgenic cells, tissues and/or organs, e.g., pancreatic tissues or cells, provided herein are transplanted into a primate, e.g., a human, and, after transplant, the primate requires less or no immunosuppressive therapy. Less or no immunosuppressive therapy includes, but is not limited to, a reduction (or complete elimination of) in dose of the immunosuppressive drug(s)/agent(s) compared to that required by other methods; a reduction (or complete elimination of) in the number of types of immunosuppressive drug(s)/agent(s) compared to that required by other methods; a reduction (or complete elimination of) in the duration of immunosuppression treatment compared to that required by other methods; and/or a reduction (or complete elimination of) in maintenance immunosuppression compared to that required by other methods.

The methods disclosed herein can be used for treating or preventing disease in a recipient (e.g., a human or non-human animal). A recipient can be any non-human animal or a human. For example, a recipient can be a mammal. Other examples of recipient include but are not limited to primates, e.g., a monkey, a chimpanzee, a bamboo, or a human. If a recipient is a human, the recipient can be a human in need thereof. The methods described herein can also be used in non-primate, non-human recipients, for example, a recipient can be a pet animal, including, but not limited to, a dog, a cat, a horse, a wolf, a rabbit, a ferret, a gerbil, a hamster, a chinchilla, a fancy rat, a guinea pig, a canary, a parakeet, or a parrot. If a recipient is a pet animal, the pet animal can be in need thereof. For example, a recipient can be a dog in need thereof or a cat in need thereof.

Transplanting can be by any transplanting known to the art. Graft can be transplanted to various sites in a recipient. Sites can include, but not limited to, liver subcapsular space, splenic subcapsular space, renal subcapsular space, omentum, gastric or intestinal submucosa, vascular segment of small intestine, venous sac, testis, brain, spleen, or cornea. For example, transplanting can be subcapsular transplanting. Transplanting can also be intramuscular transplanting. Transplanting can be intraportal transplanting.

Transplanting can be of one or more cells, tissues, and/or organs from a human or non-human animal. For example, the tissue and/or organs can be, or the one or more cells can be from, a brain, heart, lungs, eye, stomach, pancreas, kidneys, liver, intestines, uterus, bladder, skin, hair, nails, ears, glands, nose, mouth, lips, spleen, gums, teeth, tongue, salivary glands, tonsils, pharynx, esophagus, large intestine, small intestine, rectum, anus, thyroid gland, thymus gland, bones, cartilage, tendons, ligaments, suprarenal capsule, skeletal muscles, smooth muscles, blood vessels, blood, spinal cord, trachea, ureters, urethra, hypothalamus, pituitary, pylorus, adrenal glands, ovaries, oviducts, uterus, vagina, mammary glands, testes, seminal vesicles, penis, lymph, lymph nodes or lymph vessels. The one or more cells can also be from a brain, heart, liver, skin, intestine, lung, kidney, eye, small bowel, or pancreas. The one or more cells are from a pancreas, kidney, eye, liver, small bowel, lung, or heart. The one or more cells can be from a pancreas. The one or more cells can be pancreatic islet cells, for example, pancreatic β cells. Further, the one or more cells can be pancreatic islet cells and/or cell clusters or the like, including, but not limited to pancreatic α cells, pancreatic β cells, pancreatic δ cells, pancreatic F cells (e.g., PP cells), or pancreatic ε cells. In one instance, the one or more cells can be pancreatic α cells. In another instance, the one or more cells can be pancreatic β cells.

As discussed above, a genetically modified non-human animal can be used in xenograft (e.g., cells, tissues and/or organ) donation. Solely for illustrative purposes, genetically modified non-human animals, e.g., pigs, can be used as donors of pancreatic tissue, including but not limited to, pancreatic islets and/or islet cells. Pancreatic tissue or cells derived from such tissue can comprise pancreatic islet cells, or islets, or islet-cell clusters. For example, cells can be pancreatic islets which can be transplanted. More specifically, cells can be pancreatic β cells. Cells also can be insulin-producing. Alternatively, cells can be islet-like cells. Islet cell clusters can include any one or more of α, β, δ, PP or ε cells. Aptly the disease to be treated by methods and compositions herein can be diabetes. Aptly the transplantable grafts can be pancreatic islets and/or cells from pancreatic islets. Aptly the modification to the transgenic animal is to the pancreatic islets or cells from the pancreatic islets. Aptly the pancreatic islets or cells from the pancreatic islets are porcine. In some cases, cells from the pancreatic islets are or include pancreatic β cells.

Donor non-human animals can be at any stage of development including, but not limited to, fetal, neonatal, young and adult. For example, donor cells islet cells can be isolated from adult non-human animals. Donor cells, e.g., islet cells, can also be isolated from fetal or neonatal non-human animals. Donor non-human animals can be under the age of 10, 9, 8, 7, 6, 5, 4, 3, 2, or 1 year(s). For example, islet cells can be isolated from a non-human animal under the age of 6 years. Islet cells can also be isolated from a non-human animal under the age of 3 years. Donors can be non-human animals and can be any age from or from about 0 (including a fetus) to 2; 2 to 4; 4 to 6; 6 to 8; or 8 to 10 years. A non-human animal can be older than or than about 10 years. Donor cells can be from a human as well.

Islet cells can be isolated from non-human animals of varying ages. For example, islet cells can be isolated from or from about newborn to 2 year old non-human animals. Islets cells can also be isolated from or from about fetal to 2 year old non-human animals. Islets cells can be isolated from or from about 6 months old to 2 year old non-human animals. Islets cells can also be isolated from or from about 7 months old to 1 year old non-human animals. Islets cells can be isolated from or from about 2-3 year old non-human animals. In some cases, non-human animals can be less than 0 years (e.g., a fetus or embryo). In some cases, neonatal islets can be more hearty and consistent post-isolation than adult islets, can be more resistant to oxidative stress, can exhibit significant growth potential (likely from a nascent islet stem cell subpopulation), such that they can have the ability to proliferate post-transplantation and engraftment in a transplantation site.

With regards to treating diabetes, neonatal islets can have the disadvantage that it can take them up to or up to about 4-6 weeks to mature enough such that they produce significant levels of insulin, but this can be overcome by treatment with exogenous insulin for a period sufficient for the maturation of the neonatal islets. In xenograft transplantation, survival and functional engraftment of neo-natal islets can be determined by measuring donor-specific c-peptide levels, which are easily distinguished from any recipient endogenous c-peptide.

As discussed above, adult cells can be isolated. For example, adult non-human animal islets, e.g., adult porcine cells, can be isolated. Islets can then be cultured for or for about 1-3 days prior to transplantation in order to deplete the preparation of contaminating exocrine tissue. Prior to treatment, islets can be counted, and viability assessed by double fluorescent calcein-AM and propidium iodide staining. Islet cell viability >75% can be used. However, cell viability greater than or greater than about 40%, 50%, 60%, 70%, 80%, 90%, 95%, 99% can be used. For example, cells that exhibit a viability from or from about 40% to 50%; 50% to 60%; 60% to 70%; 70% to 80%; 80% to 90%; 90% to 95%, or 90% to 100% can be used. Additionally, purity can be greater than or greater than about 80% islets/whole tissue. Purity can also be at least or at least about 40%, 50%, 60%, 70%, 80%, 90%, 95%, or 99% islets/whole tissue. For example, purity can be from or can be from about 40% to 50%; 50% to 60%; 60% to 70%; 70% to 80%; 80% to 90%; 90% to 100%; 90% to 95%, or 95% to 100%.

Functional properties of islets, including dynamic perifusion and viability, can be determined in vitro prior to treatment (Balamurugan, 2006). For example, non-human animal islet cells, e.g., transgenic porcine islet cells can be cultured in vitro to expand, mature, and/or purify them so that they are suitable for grafting.

Islet cells can also be isolated by standard collagenase digestion of minced pancreas. For example, using aseptic techniques, glands can be distended with tissue dissociating enzymes (a mixture of purified enzymes formulated for rapid dissociation of a pancreas and maximal recovery of healthy, intact, and functional islets of Langerhans, where target substrates for these enzymes are not fully identified, but are presumed to be collagen and non-collagen proteins, which comprise intercellular matrix of pancreatic acinar tissue) (1.5 mg/ml), trimmed of excess fat, blood vessels and connective tissue, minced, and digested at 37 degree C. in a shaking water bath for 15 minutes at 120 rpm. Digestion can be achieved using lignocaine mixed with tissue dissociating enzymes to avoid cell damage during digestion. Following digestion, the cells can be passed through a sterile 50 mm to 1000 mm mesh, e.g., 100 mm, 200 mm, 300 mm, 400 mm, 500 mm, 600 mm, 700 mm, 800 mm, 900 mm, or 1000 mm mesh into a sterile beaker. Additionally, a second digestion process can be used for any undigested tissue.

Islets can also be isolated from the adult pig pancreas (Brandhorst et al., 1999). The pancreas is retrieved from a suitable source pig, peri-pancreatic tissue is removed, the pancreas is divided into the splenic lobe and in the duodenal/connecting lobe, the ducts of each lobes are cannulated, and the lobes are distended with tissue dissociating enzymes. The pancreatic lobes are placed into a Ricordi chamber, the temperature is gradually increased to 28 to 32° C., and the pancreatic lobes are dissociated by means of enzymatic activity and mechanical forces. Liberated islets are separated from acinar and ductal tissue using continuous density gradients. Purified pancreatic islets are cultured for or for about 2 to 7 days, subjected to characterization, and islet products meeting all specifications are released for transplantation (Korbutt et al., 2009).

Donor cells, organs, and/or tissues before, after, and/or during transplantation can be functional. For example, transplanted cells, organs, and/or tissues can be functional for at least or at least about 1, 5, 10, 20, 30 days after transplantation. Transplanted cells, organs, and/or tissues can be functional for at least or at least about 1, 2, 3, 4, 5, 6, 7, 8, 9, 10, 11, or 12 months after transplantation. Transplanted cells, organs, and/or tissues can be functional for at least or at least about 1, 2, 3, 4, 5, 6, 7, 8, 9, 10, 15, 20, 25, or 30 years after transplantation. In some cases, transplanted cells, organs, and/or tissues can be functional for up to the lifetime of a recipient. This can indicate that transplantation was successful. This can also indicate that there is no rejection of the transplanted cells, tissues, and/or organs.

Further, transplanted cells, organs, and/or tissues can function at 100% of its normal intended operation. Transplanted cells, organs, and/or tissues can also function at least or at least about 50, 60, 65, 70, 75, 80, 85, 90, 95, 99, or 100% of its normal intended operation, e.g., from or from about 50 to 60; 60 to 70; 70 to 80; 80 to 90; 90 to 100%. In certain instances, the transplanted cells, organs, and/or tissues can function at greater 100% of its normal intended operation (when compared to a normal functioning non-transplanted cell, organ, or tissue as determined by the American Medical Association). For example, the transplanted cells, organs, and/or tissues can function at or at about 110, 120, 130, 140, 150, 175, 200% or greater of its normal intended operation, e.g., from or from about 100 to 125; 125 to 150; 150 to 175; 175 to 200%.

In certain instances, transplanted cells can be functional for at least or at least about 1 day. Transplanted cells can also functional for at least or at least about 7 day. Transplanted cells can be functional for at least or at least about 14 day. Transplanted cells can be functional for at least or at least about 21 day. Transplanted cells can be functional for at least or at least about 28 day. Transplanted cells can be functional for at least or at least about 60 days.

Another indication of successful transplantation can be the days a recipient does not require immunosuppressive therapy. For example, after treatment (e.g., transplantation) provided herein, a recipient can require no immunosuppressive therapy for at least or at least about 1, 5, 10, 100, 365, 500, 800, 1000, 2000, 4000 or more days. This can indicate that transplantation was successful. This can also indicate that there is no rejection of the transplanted cells, tissues, and/or organs.

In some cases, a recipient can require no immunosuppressive therapy for at least or at least about 1 day. A recipient can also require no immunosuppressive therapy for at least or at least about 7 days. A recipient can require no immunosuppressive therapy for at least or at least about 14 days. A recipient can require no immunosuppressive therapy for at least or at least about 21 days. A recipient can require no immunosuppressive therapy for at least or at least about 28 days. A recipient can require no immunosuppressive therapy for at least or at least about 60 days. Furthermore, a recipient can require no immunosuppressive therapy for at least or at least about 1, 2, 3, 4, 5, 6, 7, 8, 9, 10, 15, 20, 30, 40, or 50 years, e.g., for at least or at least about 1 to 2; 2 to 3; 3 to 4; 4 to 5; 1 to 5; 5 to 10; 10 to 15; 15 to 20; 20 to 25; 25 to 50 years.

Another indication of successful transplantation can be the days a recipient requires reduced immunosuppressive therapy. For example, after the treatment provided herein, a recipient can require reduced immunosuppressive therapy for at least or at least about 1, 5, 10, 50, 100, 200, 300, 365, 400, 500 days, e.g., for at least or at least about 1 to 30; 30 to 120; 120 to 365; 365 to 500 days. This can indicate that transplantation was successful. This can also indicate that there is no or minimal rejection of the transplanted cells, tissues, and/or organs.

For example, a recipient can require reduced immunosuppressive therapy for at least or at least about 1 day. A recipient can also require reduced immunosuppressive therapy for at least 7 days. A recipient can require reduced immunosuppressive therapy for at least or at least about 14 days. A recipient can require reduced immunosuppressive therapy for at least or at least about 21 days. A recipient can require reduced immunosuppressive therapy for at least or at least about 28 days. A recipient can require reduced immunosuppressive therapy for at least or at least about 60 days. Furthermore, a recipient can require reduced immunosuppressive therapy for at least or at least about 1, 2, 3, 4, 5, 6, 7, 8, 9, 10, 15, 20, 30, 40, or 50 years, e.g., for at least or at least about 1 to 2; 2 to 3; 3 to 4; 4 to 5; 1 to 5; 5 to 10; 10 to 15; 15 to 20; 20 to 25; 25 to 50 years.

"Reduced" and its grammatical equivalents as used herein can refer to less immunosuppressive therapy compared to a required immunosuppressive therapy when one or more wild-type cells is transplanted into a recipient.

Immunosuppressive Therapy

Immunosuppressive therapy can comprise any treatment that suppresses the immune system. Immunosuppressive therapy can help to alleviate, minimize, or eliminate transplant rejection in a recipient. For example, immunosuppressive therapy can comprise immuno-suppressive drugs. Immunosuppressive drugs that can be used before, during and/or after transplant are any known to one of skill in the art and include, but are not limited to, MMF (mycophenolate mofetil (Cellcept)), ATG (anti-thymocyte globulin), anti-CD154 (CD4OL), anti-CD40 (2C10, ASKP1240, CCFZ533X2201), alemtuzumab (Campath), anti-CD20 (rituximab), anti-IL-6R antibody (tocilizumab, Actemra), anti-IL-6 antibody (sarilumab, olokizumab), CTLA4-Ig (Abatacept/Orencia), belatacept (LEA29Y), sirolimus (Rapimune), everolimus, tacrolimus (Prograf), daclizumab (Ze-napax), basiliximab (Simulect), infliximab (Remicade), cyclosporin, deoxyspergualin, soluble complement receptor 1, cobra venom factor, compstatin, anti C5 antibody (eculizumab/Soliris), methylprednisolone, FTY720, everolimus, leflunomide, anti-IL-2R-Ab, rapamycin, anti-CXCR3 antibody, anti-ICOS antibody, anti-OX40 antibody, and anti-CD122 antibody. Furthermore, one or more than one immunosuppressive agents/drugs can be used together or sequentially. One or more than one immunosuppressive agents/drugs can be used for induction therapy or for maintenance therapy. The same or different drugs can be used during induction and maintenance stages. In some cases, daclizumab (Zenapax) can be used for induction therapy and tacrolimus (Prograf) and sirolimus (Rapimune) can be used for maintenance therapy. Daclizumab (Zenapax) can also be used for induction therapy and low dose tacrolimus (Prograf) and low dose sirolimus (Rapimune) can be used for maintenance therapy. Immunosuppression can also be achieved using non-drug regimens including, but not limited to, whole body irradiation, thymic irradiation, and full and/or partial splenectomy. These techniques can also be used in combination with one or more immuno-suppressive drug.

Transgenic pancreatic islet cells can be transplanted using any means known in the art, including, but not limited to, introduction via a recipient organism's portal vein, liver subcapsular space, splenic subcapsular space, renal subcapsular space, omentum, gastric or intestinal submucosa, vascular segment of small intestine, venous sac, testis, brain, cornea or spleen. For example, a method of xenotransplantation can be to transplant pancreatic cells, e.g., porcine pancreatic cells, provided herein into a primate, e.g., a human, where islets are administered by intraportal infusion. A method of xenotransplantation can be provided to transplant pancreatic cells provided herein into a primate where islets are administered via the intraperitoneal space, renal subcapsule, renal capsule, omentum, or via pancreatic bed infusion. For example, transplanting can be subcapsular transplanting, intramuscular transplanting, or intraportal transplanting.

Both allotransplants and xenotransplants can sometimes be subject to recurrent autoimmunity. For example, with regards to islet cell transplantation, islet β cells can be attacked and destroyed after transplantation by autoreactive T cells, for example, by CD8+ autoreactive T cells, and autoreactive antibodies. When recipients are given tolerizing vaccines autoimmune recurrence can be prevented. For example, when tolerizing vaccines are engineered to also present autoantigens such as insulin B9-23 on the surface of apoptotic carrier cells or microparticles such as polystyrene particles, tolerance to autoantigens can be restored, and autoimmune recurrence can be prevented. For example, with respect to diabetes, the tolerizing vaccine as disclosed herein can prevent the onset of autoimmune Type 1 diabetes or prevent autoimmune recurrence in transplanted islet β cells.

The tolerizing vaccine can also be given to a recipient to prevent or treat diabetes (e.g., type 1, type 2, gestational, surgical, cystic fibrosis-related diabetes, or mitochondrial diabetes. In some cases, a disease can be hereditary diabetes or a type of hereditary diabetes).

Additionally, for both allotransplants and xenotransplants, disrupting genes such as NLRC5, TAP1, and B2M in the grafts can cause lack of functional expression of MHC class I on graft cells including on islet beta cells, thereby interfering with the posttransplant activation of autoreactive CD8+ T cells. Thus, this can protect the transplant, e.g., transplanted islet beta cells, from the cytolytic effector functions of autoreactive CD8+ T cells.

Inducing the Tolerance of Transplant Grafts in a Recipient Using Tolerizing Vaccines A tolerizing vaccine comprising ECDI-treated cells can be administered before, after, and/or during transplant of donor cells, organs, and/or tissues to induce donor-specific tolerance in a recipient. As an example show in FIG. 4, a pig islet is transplanted to a recipient (e.g., a human or a non-human animal) on day 0. Apoptotic cells (e.g., tolerizing vaccine) derived from the same donor pig can be first administered 7 days before islet transplant (day −7) for inducing tolerance to the xenograft (e.g., pig islet from the same donor). An additional tolerizing vaccine can be administered 1 day after islet transplant (day 1) to booster tolerance (FIG. 4). Furthermore, administration of a tolerizing vaccine can be accompanied by administration of transient immunosuppression (FIG. 4). In some cases, a tolerizing vaccine comprising ECDI-treated cells can be administered on or on about day −100, day −90, day −80, day −70, day −60, day −50, day −40, day −30, day −20, day −15, day −14, day −13, day −12, day −11, day −10, day −9, day −8, day −7, day −6, day −5, day −4, day −3, day −2 or day −1, relative to transplant of donor cells, organs, and/or tissues on day 0, e.g., on or on about day −100 to −50; −50 to −40; −40 to −30; −30 to −20; −20 to −10; −10 to −5; −7 to −1. For example, a tolerizing vaccine comprising ECDI-treated cells can be administered 7 days before (e.g., day −7) transplant of donor cells, organs, and/or tissues. In some cases, a tolerizing vaccine comprising ECDI-treated cells can be administered on the same day (e.g., day 0) as transplant of donor cells, organs, and/or tissues. In some cases, ECDI-treated cells can be administered on or on about day 100, day 90, day 80, day 70, day 60, day 50, day 40, day 30, day 20, day 15, day 14, day 13, day 12, day 11, day 10, day 9, day 8, day 7, day 6, day 5, day 4, day 3, day 2 or day 1, relative to transplant of donor cells, organs, and/or tissues on day 0. For example, a tolerizing vaccine comprising ECDI-treated cells can be administered on 1 day after (e.g., day 1) transplant of donor cells, organs, and/or tissues. In some cases, the tolerizing vaccine can be administered before and after the transplantation of donor cells, organs, and/or tissues.

Genetically modified cells, tolerizing vaccines and antibodies can be used together to suppress transplant rejection. FIG. 5 demonstrates an exemplary approach to preventing rejection and/or extending survival of a graft (e.g., a xenograft). The approach can integrate: i) genetic engineering of the graft donor; ii) genetic engineering of the vaccine donor, and iii) the administration of the genetically engineered tolerizing vaccine (apoptotic cells alone or with non-apoptotic cells), and the graft under the cover of the transient immunosuppression. A graft donor and a vaccine donor can have the same genotype. Alternatively, a graft donor and a vaccine donor can have different genotypes. In some cases, a graft donor can comprise reduced expression of NLRC5, C3, CXCL10, and GGTA1, and transgenes comprising polynucleotides encoding HLA-G (e.g., HLA-G1) or HLA-E. In some cases, a graft donor can comprise reduced expression of TAP1, C3, CXCL10, and GGTA1, and transgenes comprising polynucleotides encoding HLA-G (e.g., HLA-G1) or HLA-E. In some cases, a graft donor can comprise reduced expression of NLRC5 and TAP1, C3, CXCL10, and GGTA1, and transgenes comprising polynucleotides encoding HLA-G (e.g., HLA-G1) or HLA-E. A vaccine donor can have reduced expression of GGTA1, CMAH, B4GALNT2 and/or transgenes comprising polynucleotides encoding HLA-G (e.g., HLA-G1), CD47 (e.g., human CD47), PD-L1 (e.g., human PD-L1), and PD-L2 (e.g., human PD-L2). A vaccine donor can have reduced expression of GGTA1, CMAH, B4GALNT2 and/or transgenes comprising polynucleotides encoding HLA-E, CD47 (e.g., human CD47), PD-L1 (e.g., human PD-L1), and PD-L2 (e.g., human PD-L2). The vaccines in some instances can be given to a transplant recipient before (e.g., on day −7) and/or after (e.g., on day 1). Other immunosuppression reagents, e.g., one or more of anti-CD40 antibodies, anti-CD20 antibodies, rapamycin, compstatin, anti-IL-6R antibodies, and sTNFR, a nitrogen mustard alkylating agent (e.g., cyclophosphamide) can also be given to the subject before and/or after transplant.

In addition to the genetically modified cells, tissues, organs, tolerizing vaccines and anti-CD40 antibodies disclosed herein, one or more additional immunosuppression agents can also be administered to a subject receiving the genetically modified cells, tissues, organs, tolerizing vaccines and/or anti-CD40 antibodies. The additional immunosuppression agent can be administered to a subject, e.g., to enhance the tolerogenic efficacy of a tolerizing vaccine in the subject. The additional immunosuppression agent can include a B-cell depleting antibody, an mTOR inhibitor, a TNF-alpha inhibitor, a IL-6 inhibitor, a nitrogen mustard alkylating agent (e.g., cyclophosphamide), a complement C3 or C5 inhibitor, or any combination thereof.

The additional immunosuppression agent, e.g., can be a nitrogen mustard alkylating agent. For example, the additional immunosuppression agent can be cyclophosphamide.

The additional immunosuppression agent can be administered before, after, and/or during the administration of a tolerizing vaccine. In some cases, the additional immunosuppression agent can be administered between day −100 and day 0, e.g., on day −90, day −80, day −70, day −60, day −50, day −40, day −30, day −20, day −15, day −14, day −13, day −12, day −11, day −10, day −9, day −8, day −7, day −6, day −5, day −4, day −3, day −2 or day −1, relative to the administration of a tolerizing vaccine. In some cases, the additional immunosuppression agent can be administered on or on about day −100 to −50; −50 to −40; −40 to −30; −30 to −20; −20 to −10; −10 to −5; −7 to −1, relative to the administration of a tolerizing vaccine. In some cases, the additional immunosuppression agent can be administered between day 0 and day 100, e.g., on day 100, day 90, day 80, day 70, day 60, day 50, day 40, day 30, day 20, day 15, day 14, day 13, day 12, day 11, day 10, day 9, day 8, day 7, day 6, day 5, day 4, day 3, day 2 or day 1 relative to the administration of a tolerizing vaccine. For example, the immunosuppression agent can be administered on or on about day 100 to 50; 50 to 40; 40 to 30; 30 to 20; 20 to 10; 10 to 5; 7 to 1, relative to the administration of a tolerizing vaccine. In some cases, the additional immunosuppression agent can be administered on the day when a tolerizing vaccine is administered. In other cases, the additional immunosuppression can be administered before and after the administration of the tolerizing vaccine. For example, cyclophosphamide can be administered on or on about day 3 after the administration of a tolerizing vaccine.

A tolerogenic efficacy regulator (e.g., cyclophosphamide) can be administered at dose from or from about 5 to 100 mg/kg/day. The unit "mg/kg/day" can refer to the number of milligrams of the tolerogenic efficacy regulator given per kilogram of the subject's body weight per day. In some cases, a tolerogenic efficacy regulator (e.g., cyclophosphamide) can be administered at a dose of from or from about 20 mg/kg/day to 100 mg/kg/day; 30 mg/kg/day to 90 mg/kg/day; 40 mg/kg/day to 80 mg/kg/day; 50 mg/kg/day to 70 mg/kg/day; 50 mg/kg/day to 60 mg/kg/day; or 40 mg/kg/day to 60 mg/kg/day.

Cells (e.g., splenocytes) can be treated with ECDI in the presence of suitable antigen(s) and/or epitope(s) (e.g., CD4). ECDI-treatment can result in coupling of antigen(s) and/or epitope(s) to ECDI-treated cells. Other conjugates such as hexamethylene diisocyanate, propyleneglycol di-glycidylether which contain 2 epoxy residues, and epichlorohydrin can also be used to treat cells and couple antigens(s) and/or epitope(s) to make cells for tolerizing vaccines.

Antigen-coupled and/or epitope-coupled cells (e.g., ECDI-induced coupling) can be administered before, during, and/or after administration of donor transplant cells, organs, and/or tissues to induce tolerance for the cells, organs, and/or tissues in a recipient (e.g., a human or a non-human animal). In some cases, antigen-coupled and/or epitope-coupled cells can be administered on day −100, day −90, day −80, day −70, day −60, day −50, day −40, day −30, day −20, day −15, day −14, day −13, day −12, day −11, day −10, day −9, day −8, day −7, day −6, day −5, day −4, day −3, day −2 or day −1, relative to transplant of donor cells, organs, and/or tissues on day 0. In some cases, the antigen-coupled and/or epitope-coupled cells can be administered on or about on day −100 to −50; −50 to −40; −40 to −30; −30 to −20; −20 to −10; −10 to −5; −7 to −1, relative to transplant of donor cells, organs, and/or tissues on day 0. For example, antigen-coupled and/or epitope-coupled cells can be administered 7 days before (e.g., day −7) transplant of donor cells, organs, and/or tissues. In some cases, antigen-coupled and/or epitope-coupled cells can be administered on the same day (e.g., day 0) as the transplant of donor cells, organs, and/or tissues. In some cases, antigen-coupled and/or epitope-coupled cells can be administered on day 100, day 90, day 80, day 70, day 60, day 50, day 40, day 30, day 20, day 15, day 14, day 13, day 12, day 11, day 10, day 9, day 8, day 7, day 6, day 5, day 4, day 3, day 2 or day 1, relative to transplant of donor cells, organs, and/or tissues on day 0. For example, the antigen-coupled and/or epitope-coupled cells can be administered on or on about day 100 to 50; 50 to 40; 40 to 30; 30 to 20; 20 to 10; 10 to 5; 7 to 1, relative to transplant of donor cells, organs, and/or tissues on day 0. For example, antigen-coupled and/or epitope-coupled cells can be administered on 1 day after (e.g., day 1) transplant of donor cells, organs, and/or tissues.

ECDI-treated cells, antigen-coupled cells, and/or epitope-coupled cells can be administered to a recipient prior to transplantation of donor cells, organs, and/or tissues to a recipient. ECDI-treated cells, antigen-coupled cells, and/or epitope-coupled cells can be co-administered to a recipient prior to transplantation of donor cells, organs, and/or tissues to a recipient. ECDI-treated cells, antigen-coupled cells, and/or epitope-coupled cells can be administered to a recipient following transplantation of donor cells, organs, and/or tissues to a recipient. Administration of ECDI-treated cells, antigen-coupled cells, and/or epitope-coupled cells to a transplant recipient before, during, and/or after transplantation can result in increased tolerance of transplanted cells, organs, and/or tissues. For example, ECDI-treated cells, antigen-coupled cells, and/or epitope-coupled cells can increase initial tolerance, long-term tolerance, and/or total acceptance of transplanted cells, organs, and/or tissues. In some cases, administering ECDI-treated cells (e.g. epitope-coupled cells) to a transplant recipient can result in tolerance of transplanted materials without additional immunosuppression or anti-rejection therapies.

Tolerizing vaccines can reduce the dose or duration of immunosuppression required to prevent rejection of cells, organs, and/or tissues. Tolerizing vaccines can reduce the dose of immunosuppression required by at least or at least about 5%. For example, Tolerizing vaccines reduce the dose of immunosuppression required by at least or at least about 5%, 10%, 20%, 30%, 40%, 50%, 60%, 65%, 70%, 75%, 80%, 85%, 90%, 95%, or 100%, e.g., by at least or at least about 5 to 25; 25 to 50; 50 to 75; 75 to 85; 85 to 90; 90 to 95; 95 to 100%. In some cases, a transplant recipient can require no immunosuppression after administration of a tolerizing vaccine. The term "reduce" and its grammatical equivalents as used herein can refer to using less immunosuppression compared to a required dose of immunosuppression when one or more wild-type cells, organs, and/or tissues is transplanted into a recipient (e.g., a human or a non-human animal). The term "reduce" can also refer to using less immunosuppressive drug(s) or agent(s) compared to a required dose of immunosuppression when one or more wild-type cells, organs, and/or tissues is transplanted into a recipient (e.g., a human or a non-human animal).

A recipient (e.g., a human or a non-human animal) can require a reduced dose of immunosuppression for at least or at least about 1, 5, 10, 20, 30, 40, 50, 60, 70, 80, 90, or 100 days after transplantation, e.g., for at least or at least about 1 to 5; 5 to 10; 10 to 20; 20 to 30; 30 to 60; 60 to 100 days. A recipient (e.g., a human or a non-human animal) can require a reduced dose of immunosuppression for at least or at least about 1, 2, 3, 4, 5, 6, 7, 8, 9, 10, 11, or 12 months after transplantation, e.g., for at least or at least about 1 to 2; 2 to 3; 3 to 6; 6 to 9; 9 to 12 months after transplantation. A recipient (e.g., a human or a non-human animal) can require a reduced dose of immunosuppression for at least or at least about 1, 2, 3, 4, 5, 6, 7, 8, 9, 10, 15, 20, 25, or 30 years after transplantation, e.g. for at least or at least about 1 to 2; 2 to 3; 3 to 4; 4 to 5; 1 to 5; 5 to 10; 10 to 15; 15 to 20; 20 to 25; 25 to 30 years after transplantation. In some cases, a recipient (e.g., a human or a non-human animal) can require a reduced dose of immunosuppression for up to the lifetime of the recipient.

A recipient (e.g., a human or a non-human animal) can require no immunosuppression for at least or at least about 1, 5, 10, 20, 30, 40, 50, 60, 70, 80, 90, or 100 days after transplantation, e.g., for at least or at least about 1 to 5; 5 to 10; 10 to 20; 20 to 30; 30 to 60; 60 to 100 days. A recipient (e.g., a human or a non-human animal) can require a reduced dose of immunosuppression for at least or at least about 1, 2, 3, 4, 5, 6, 7, 8, 9, 10, 11, or 12 months after transplantation e.g., for at least or at least about 1 to 2; 2 to 3; 3 to 6; 6 to 9; 9 to 12 months after transplantation. A recipient (e.g., a human or a non-human animal) can require a reduced dose of immunosuppression for at least or at least about 1, 2, 3, 4, 5, 6, 7, 8, 9, 10, 15, 20, 25, or 30 years after transplantation, e.g. for at least or at least about 1 to 2; 2 to 3; 3 to 4; 4 to 5; 1 to 5; 5 to 10; 10 to 15; 15 to 20; 20 to 25; 25 to 30 years after transplantation. In some cases, a recipient (e.g., a human or a non-human animal) can require no immunosuppression for up to the lifetime of the recipient.

Immunosuppression described herein can refer to the immunosuppression administered immediately before, after, and/or during transplantation. Immunosuppression described herein can also refer to the maintenance immunosuppression administered at least or at least about 1, 2, 3, 4, 5, 6, 7, 8, 9, 10, 20, 30, 40, 50, 60, 70, 80, 90, or 100 days (e.g., for at least or at least about 1 to 5; 5 to 10; 10 to 20; 20 to 30; 30 to 60; 60 to 100 days) or 1, 2, 3, 4, 5, 6, 7, 8, 9, 10, 15, 20, 25, or 30 years (e.g., for at least or at least about 1 to 2; 2 to 3; 3 to 4; 4 to 5; 1 to 5; 5 to 10; 10 to 15; 15 to 20; 20 to 25; 25 to 30 years) after transplantation. Tolerizing vaccines can increase survival of cells, organs, and/or tissues without need for maintenance immunosuppression.

Immunosuppression can be used in immunosuppressive therapy to suppress transplant rejection in a recipient. Immunosuppressive therapy can comprise any treatment that suppresses transplant rejection in a recipient (e.g., a human or a non-human animal). Immunosuppressive therapy can comprise administering immuno-suppressive drugs. Immunosuppressive drugs that can be used before, during, and/or after transplant include, but are not limited to, MMF (mycophenolate mofetil (Cellcept)), ATG (anti-thymocyte globulin), anti-CD154 (CD4OL), alemtuzumab (Campath), anti-CD20 (rituximab), anti-IL-6R antibody (tocilizumab, Actemra), anti-IL-6 antibody (sarilumab, olokizumab), CTLA4-Ig (Abatacept/Orencia), belatacept (LEA29Y), sirolimus (Rapimune), tacrolimus (Prograf), daclizumab (Ze-napax), basiliximab (Simulect), infliximab (Remicade), cyclosporin, deoxyspergualin, soluble complement receptor 1, cobra venom factor, compstatin, anti C5 antibody (eculizumab/Soliris), methylprednisolone, FTY720, everolimus, anti-CD154-Ab, leflunomide, anti-IL-2R-Ab, rapamycin, anti-CXCR3 antibody, anti-ICOS antibody, anti-OX40 antibody, and anti-CD122 antibody, and human anti-CD154 monoclonal antibody. One or more than one immunosuppressive agents/drugs can be used together or sequentially. One or more than one immunosuppressive agents/drugs can be used for induction therapy or for maintenance therapy. The same or different drugs can be used during induction and maintenance stages. For example, daclizumab (Zenapax) is used for induction therapy and tacrolimus (Prograf) and sirolimus (Rapimune) is used for maintenance therapy. In another example, daclizumab (Zenapax) is used for induction therapy and low dose tacrolimus (Prograf) and low dose sirolimus (Rapimune) is used for maintenance therapy. Immunosuppression can also be achieved using non-drug regimens including, but not limited to, whole body irradiation, thymic irradiation, and full and/or partial splenectomy. These techniques can also be used in combination with one or more immuno-suppressive drug.

Antibody Treatment

Both allografts and xenografts that escape fulminant, hyperacute, and/or acute vascular rejection are subjected to T cell mediated rejection. $CD4^+$ and $CD8^+$ T lymphocytes contribute to rejection. These T cells can be activated via the direct pathway of immune recognition involving presentation by donor antigen presenting cells to T cells or via the indirect pathway involving presentation of internalized soluble donor antigen by host antigen presenting cells. $CD8^+$ T cells are main mediators of rejection. B cells promote proliferation of activated anti-donor $CD4^+$ T cells, survival of anti-donor $CD8^+$ T cells, and T cell memory generation by mechanisms such as antigen presentation, cytokine production, and co-stimulation. The compositions and methods disclosed herein can be used to reduce a recipient's direct immune responses, indirect immune responses, or both to a cell, tissue or organ transplanted from a donor. The methods of treatment as described herein can comprise providing ECDI-treated cells (e.g., tolerizing vaccine) and one or more biological or chemical substances to a human. For example, ECDI-treated cells can be porcine cells, e.g., porcine splenocytes.

One or more biological or chemical substances can be an antibody. An antibody can be an anti-CD40 or anti-IL-6R. An anti-CD40 antibody can be an anti-CD40 Ab 2C10 antibody, an anti-CD40 mAb ASKP1240 (4D11) (e.g., as described in Watanabe et al., "ASKP1240, a fully human anti-CD40 monoclonal antibody, prolongs pancreatic islet allograft survival in nonhuman primates," Am J Transplant. 13(8):1976-88 (2013), or an anti-CD40 mAb CFZ533 (as described in Corodoba et al., "A Novel, Blocking, Fc-Silent Anti-CD40 Monoclonal Antibody Prolongs Nonhuman Primate Renal AllograftSurvival in the Absence of B Cell Depletion," Am J Transplant, 15(11):2825-36 (2015).

Methods described herein for immunotolerizing a recipient (e.g., a human or a non-human animal) for transplantation (e.g., xenotransplantation) can comprise providing to a recipient (e.g., a human or a non-human animal) two or more biological or chemical substances selected from a group consisting of: ECDI-treated cells, B cell depleting antibodies, antagonistic anti-CD40 antibodies, mTOR inhibitors, and TNF-alpha inhibitors, and IL-6 inhibitors, or any combination thereof. Methods herein for prolonging transplantation survival in a recipient (e.g., a human or a non-human animal) can comprise administering to the recipient (e.g., a human or a non-human animal) two or more biological substances selected from the group consisting of ECDI-treated cells, anti-CD40 Ab 2C10 antibody, sTNFR, anti- IL-6R antibody, or any combination thereof. For example, the methods can comprise providing to a recipient (e.g., a human or a non-human animal) ECDI-treated cells, where the ECDI-treated cells are disclosed herein. The methods can comprise providing to a recipient (e.g., a human or a non-human animal) B cell depleting antibodies, for example, rituximab. The methods can comprise providing to a recipient (e.g., a human or a non-human animal) antagonistic anti-CD40 antibodies, for example, humanized 2C10. The methods can comprise providing to a recipient (e.g., a human or a non-human animal) mTOR inhibitors, for example, rapamycin. The methods can comprise providing to a recipient (e.g., a human or a non-human animal) TNF-alpha inhibitors, for example, sTNFR. sTNFR can also be tocilizumab or etanercept. The methods can comprise providing to a recipient (e.g., a human or a non-human animal) an IL-6 inhibitor, for example, an anti-IL-6R antibody. In some cases, the methods can comprise providing to a recipient (e.g., a human or a non-human animal) an antibody (e.g., a monoclonal antibody) targeting a non-redundant epitope on antigen presenting cells (APC). In some cases, the methods can comprise administering pharmaceutical agents that inhibit T cell activation, B cell activation, dendritic cell activation, or any combination thereof.

The present disclosure can also provide a kit comprising two or more of the following: a splenocyte; anti-CD40 Ab 2C10 antibody; sTNFR; and anti-IL-6R antibody. For example, a kit can comprise a splenocyte and anti-CD40 Ab 2C10 antibody. A kit can comprise a splenocyte and sTNFR. A kit can comprise a splenocyte and anti-IL-6R antibody. A kit can comprise an anti-CD40 Ab 2C10 antibody and sTNFR. A kit can comprise an anti-CD40 Ab 2C10 antibody and anti-IL-6R antibody. A kit can comprise a sTNFR and anti-IL-6R antibody. A kit can comprise a splenocyte, anti-CD40 Ab 2C10 antibody and sTNFR. A kit can comprise a splenocyte, anti-CD40 Ab 2C10 antibody and anti-IL-6R antibody. A kit can comprise a splenocyte, sTNFR and anti-IL-6R antibody. A kit can comprise anti-CD40 Ab 2C10 antibody, sTNFR and anti-IL-6R antibody. A kit can comprise a splenocyte; anti-CD40 Ab 2C10 antibody; sTNFR; and anti-IL-6R antibody. A kit can further comprise a reagent for ECDI fixation.

The methods herein can comprise ECDI-treated cells, such as ECDI-treated splenocytes. In some cases, the methods can comprise providing to a recipient (e.g., a human or a non-human animal) ECDI-treated splenocytes and anti-CD40 Ab 2C10 antibody. In some cases, the methods can comprise providing to a recipient (e.g., a human or a non-human animal) ECDI-treated splenocytes and sTNFR. In some cases, the methods can comprise providing to a recipient (e.g., a human or a non-human animal) ECDI-treated splenocytes and anti-IL-6R antibody. In some cases, the methods can comprise providing to a recipient (e.g., a human or a non-human animal) anti-CD40 Ab 2C10 antibody and sTNFR. In some cases, the methods can comprise providing to a recipient (e.g., a human or a non-human animal) anti-CD40 Ab 2C10 antibody and anti-IL-6R antibody. In some cases, the methods can comprise providing to a recipient (e.g., a human or a non-human animal) ECDI-treated splenocytes, anti-CD40 Ab 2C10 antibody, and sTNFR. In some cases, the methods can comprise providing to a recipient (e.g., a human or a non-human animal) ECDI-treated splenocytes, anti-CD40 Ab 2C10 antibody, and anti-IL-6R. In some cases, the methods can comprise providing to a recipient (e.g., a human or a non-human animal) ECDI-treated splenocytes, sTNFR, and anti-IL-6R antibody. In some cases, the methods can comprise providing to a recipient (e.g., a human or a non-human animal) ECDI-treated splenocytes, anti-CD40 Ab 2C10 antibody, sTNFR, and anti-IL-6R antibody. In some cases, the methods can comprise providing to a recipient (e.g., a human or a non-human animal) ECDI-treated splenocytes, and an antibody (e.g., a monoclonal antibody) targeting a non-redundant epitope on antigen presenting cells (APC).

A donor (e.g., a donor for a transplant graft and/or a cell in a tolerizing vaccine) can be a mammal. A donor of allografts can be an unmodified human cell, tissue, and/or organ, including but not limited to pluripotent stem cells. A donor of xenografts can be any cell, tissue, and/or organ from a non-human animal, such as a mammal. In some cases, the mammal can be a pig.

The methods herein can further comprise diagnosing a recipient (e.g., a human or a non-human animal) with a disease. For example, a disease is diabetes, including but not limited to, type 1, type 2, gestational, surgical, cystic fibrosis-related diabetes, or mitochondrial diabetes. In some cases, a disease can be hereditary diabetes or a type of hereditary diabetes.

The methods herein can comprise administering ECDI-treated cells before, after, and/or during transplant of donor cells, organs, and/or tissues to induce donor-specific tolerance in a recipient. In some cases, ECDI-treated cells can be administered on or on about day −100, day −90, day −80, day −70, day −60, day −50, day −40, day −30, day −20, day −15, day −14, day −13, day −12, day −11, day −10, day −9, day −8, day −7, day −6, day −5, day −4, day −3, day −2 or day −1, relative to transplant of donor cells, organs, and/or tissues on day 0. In some cases, the antigen-coupled and/or epitope-coupled cells can be administered on or about on day −100 to −50; −50 to −40; −40 to −30; −30 to −20; −20 to −10; −10 to −5; −7 to −1, relative to transplant of donor cells, organs, and/or tissues on day 0. For example, ECDI-treated cells can be administered 7 days before (e.g., day −7) transplant of donor cells, organs, and/or tissues. In some cases, ECDI-treated cells can be administered on the same day (e.g., day 0) as transplant of donor cells, organs, and/or tissues. In some cases, ECDI-treated cells can be administered on or on about day 100, day 90, day 80, day 70, day 60, day 50, day 40, day 30, day 20, day 15, day 14, day 13, day 12, day 11, day 10, day 9, day 8, day 7, day 6, day 5, day 4, day 3, day 2 or day 1, relative to transplant of donor cells, organs, and/or tissues on day 0. For example, the antigen-coupled and/or epitope-coupled cells can be administered on or on about day 100 to 50; 50 to 40; 40 to 30; 30 to 20; 20 to 10; 10 to 5; 7 to 1, relative to transplant of donor cells, organs, and/or tissues on day 0. For example, ECDI-treated cells can be administered on 1 day after (e.g., day 1) transplant of donor cells, organs, and/or tissues.

The methods herein can comprise administering at least or at least about $0.25 \times 10^9$ ECDI-treated cells (e.g., donor splenocytes) per kg recipient body weight. For example, at least or at least about $1 \times 10^7$ $1 \times 10^8$, $0.25 \times 10^9$ $0.50 \times 10^9$ $0.75 \times 10^9$ $1.00 \times 10^9$ $1.25 \times 10^9$ $1.50 \times 10^9$, $1.75 \times 10^9$ or $2 \times 10^9$ ECDI-treated cells (e.g., donor splenocytes) per kg recipient body weight ECDI-treated cells can be administered. ECDI-treated cells can also be splenic B cells. The methods herein can comprise administering from or from about $1 \times 10^8$ to $2 \times 10^9$, e.g., $1 \times 10^8$ to $2 \times 10^8$, $1 \times 10^8$ to $3 \times 10^8$, $1 \times 10^8$ to $4 \times 10^8$, $1 \times 10^8$ to $5 \times 10^8$, $1 \times 10^8$ to $1 \times 10^9$, ECDI-treated cells (e.g., donor splenocytes) per kg recipient body weight.

Donor splenocytes can be freshly isolated. Alternatively, ECDI-treated cells can be ex-vivo expanded. In some cases, donor splenocytes comprise at least or at least about 10%, e.g., 25%, CD21 positive SLA Class II positive B cells. For example, donor splenocytes comprise at least or at least about 10%, 15%, 20%, 25%, 30%, 35%, 40%, 45%, 50%, 55% or 60% CD21 positive SLA Class II positive B cells, e.g., at least or at least about 10 to 20; 20 to 30; 30 to 40; or 40 to 50%. In some cases, splenic B cells comprise at least or at least about 60%, e.g., 90%, CD21 positive SLA Class II positive B cells. For example, splenic B cells comprise at least or at least about 60%, 65%, 70%, 75%, 80%, 85%, 90% or 95% CD21 positive SLA Class II positive B cells e.g., at least or at least about 60 to 70; 70 to 80; 80 to 90; or 90 to 95%. In some cases, donor splenocytes comprise from or from about 50% to 100%, e.g., from or from about 60% to 100% or 80% to 100%, CD21 positive SLA Class II positive B cells.

ECDI-treated cells can be given intravenously. ECDI-treated cells are infused intravenously. In some cases, ECDI-treated cells can be given intravenously in a volume of at least or at least about 1 ml, 2 ml, 3 ml, 4 ml, 5 ml, 10 ml, 20 ml, 30 ml, 40 ml or 50 ml per kg recipient body weight, e.g., at least or at least about 1 to 2; 2 to 3; 3 to 4; 4 to 5; 1 to 5; 5 to 10; 10 to 20; 20 to 30; 30 to 40; or 40 to 50. For example, ECDI-treated cells are given intravenously in a volume of 7 ml per kg recipient body weight.

The methods herein can further comprise treating a disease by transplanting one or more donor cells to an immunotolerized recipient (e.g., a human or a non-human animal).

The methods can comprise providing cells (e.g., ECDI-treated cells) one or more disrupted genes selected from NOD-like receptor family CARD domain containing 5 (NLRC5), Transporter associated with antigen processing 1 (TAP1), GGTA1, B4GALNT2, CMAH, C-X-C motif chemokine 10 (CXCL10), MHC class I polypeptide-related sequence A (MICA), MHC class I polypeptide-related sequence B (MICB), or class II major histocompatibility complex transactivator (CIITA). ECDI-treated cells can be derived from the same donor. Furthermore, ECDI-treated cells can further comprise one or more transgenes selected from ICP47, CD46, CD55, CD59, or any combination thereof. In some cases, donor cells can be islet cells. In some cases, the one or more disrupted gene does not include GGTA1.

Antagonistic anti-CD40 monoclonal antibody 2C10 can be given in combination with other immunotherapy (sTNFR, anti-IL-6R, mTOR inhibitor, with and without anti-CD20 monoclonal antibodies, and with or without CTLA4-Ig) and with or without intravenous infusion of donor apoptotic cells. This treatment can facilitate remarkable and unprecedented islet allograft and pig islet xenograft survival in primates, e.g., monkeys. For example, most remarkable is the maintenance of excellent blood glucose control in transplanted monkeys despite discontinuation of exogenous insulin and all immunosuppression on or on about day 21 posttransplant. Examples include the maintenance of excellent islet allograft function in 3 of 4 monkeys for at least or at least about 200 days (2 without and 1 with administration of donor apoptotic cells) and the maintenance of excellent islet xenograft function in 1 of 1 monkeys for at least or at least about 100 days (with administration of donor apoptotic cells).

Other methods of use can include i) transient or infrequent use of anti-CD40 monoclonal antibody 2C10 or similar antibodies for prevention of rejection of genetically modified grafts, ii) transient or infrequent use of anti-CD40 monoclonal antibody 2C10 or similar antibodies in transplantation in conjunction with other immunotherapy targeting inflammation (e.g., complement inhibitors and cytokine and chemokine inhibitors such as the IL-8 inhibitor reparaxin), and the use of anti-CD40 monoclonal antibody 2C10 or similar antibodies for prevention of stem cell-derived cellular grafts such as functional human islet beta cells.

The methods herein can comprise administering one or more dose of anti-CD40 antibody to a recipient before, after, and/or during transplant of donor cells, organs, and/or tissues to induce donor-specific tolerance in a recipient. In some cases, a first dose of anti-CD40 antibody can be given on or on about day −100, day −90, day −80, day −70, day −60, day −50, day −40, day −30, day −20, day −15, day −14, day −13, day −12, day −11, day −10, day −9, day −8, day −7, day −6, day −5, day −4, day −3, day −2 or day −1, relative to transplant of donor cells, organs, and/or tissues on day 0. In some cases, a first dose of anti-CD40 antibody can be given on or on about day −100 to −50; −50 to −40; −40 to −30; −30 to −20; −20 to −10; −10 to −5; −7 to −1, relative to transplant of donor cells, organs, and/or tissues on day 0. For example, a first dose of anti-CD40 antibody can be given 8 days (e.g., day −8) before transplant of donor cells, organs, and/or tissues.

Different doses of anti-CD40 antibody can be given to a recipient before, after, and/or during transplant of donor cells, organs, and/or tissues to induce donor-specific tolerance in a recipient. In some cases, a first dose of anti-CD40 antibody can comprise at least or at least about 1 mg, 5 mg, 10 mg, 20 mg, 30 mg, 40 mg, 50 mg, 60 mg, 70 mg, 80 mg, 90 mg, 100 mg, or 200 mg of the anti-CD40 antibody per kg recipient body weight. In certain cases, a first dose of anti-CD40 antibody can comprise at least or at least about 30 mg, 40 mg, 50 mg, 60 mg, 70 mg of the anti-CD40 antibody per kg recipient body weight. In some cases, a first dose of anti-CD40 antibody can comprise from or from about 1 mg to 200 mg, e.g., from or from about 20 mg to 100 mg; 30 mg to 80 mg; 30 mg to 70 mg; 40 mg to 70 mg; 40 mg to 60 mg; 50 mg to 70 mg; or 60 mg to 80 mg of the anti-CD40 antibody per kg recipient body weight.

Figure 6:
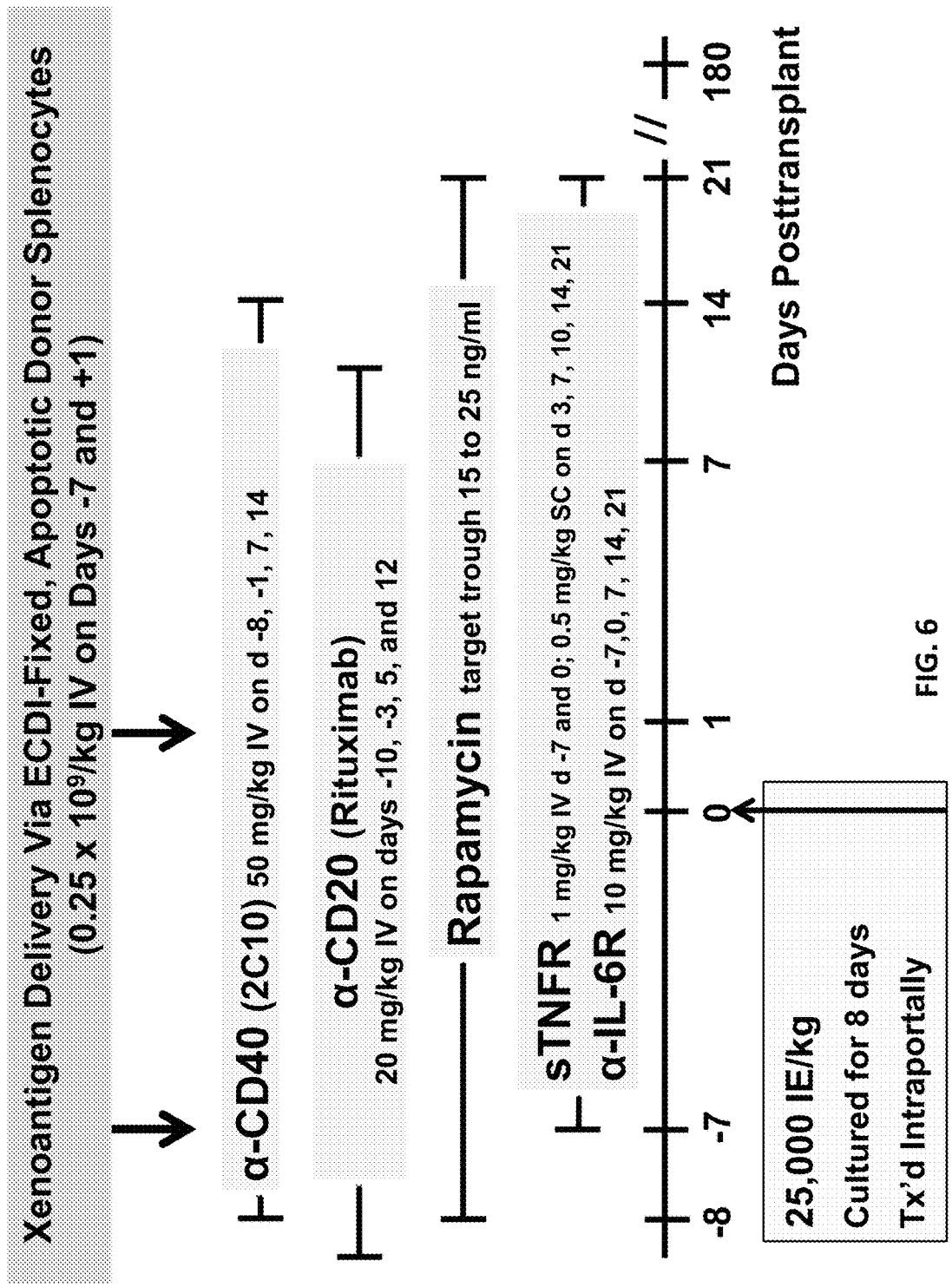
FIG. 6 demonstrates an exemplary protocol for transplant rejection prophylaxis in a pig-to-cynomolgus monkey islet xenotransplantation. IE: islet equivalent; sTNFR: soluble TNF receptor (e.g., etanercept); α-IL-6R: anti-interleukin 6 receptor; Tx'd: transplanted.
Figure 7A:
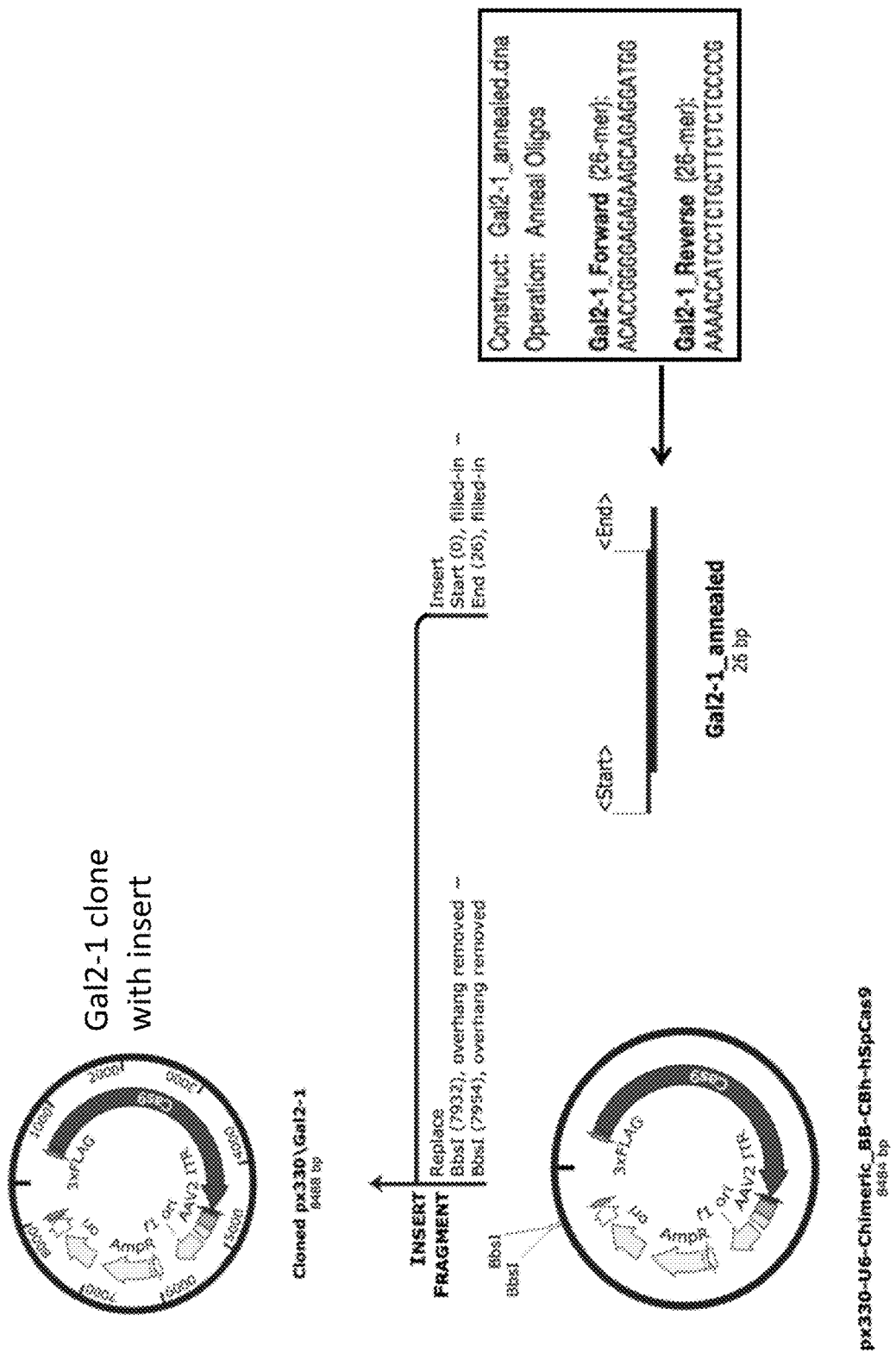
FIGS. 7A-7E demonstrate a strategy for cloning a px330-Gal2-1 plasmid targeting GGTA1.
Figure 7B:
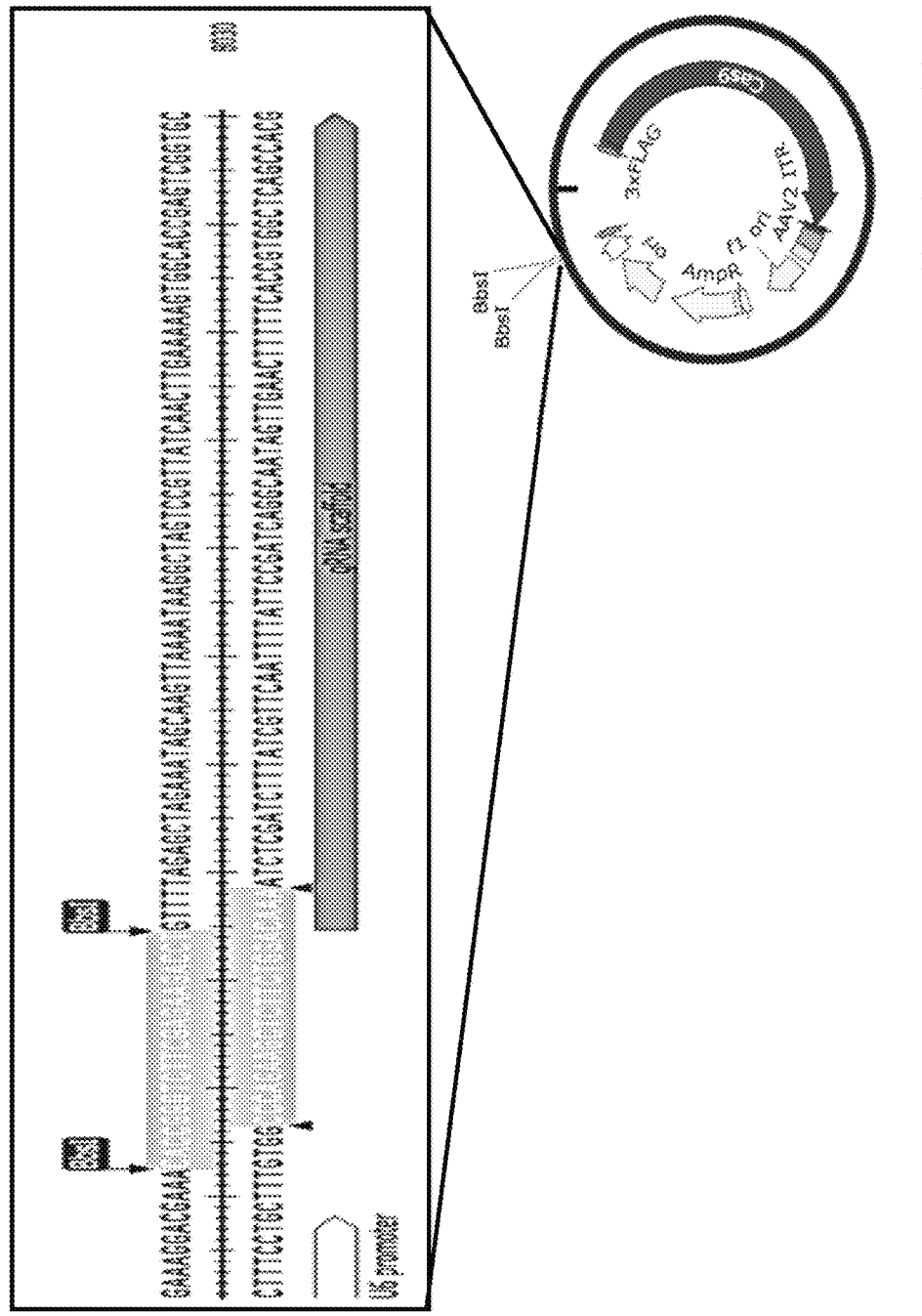
Figure 7C:
Figure 7D:
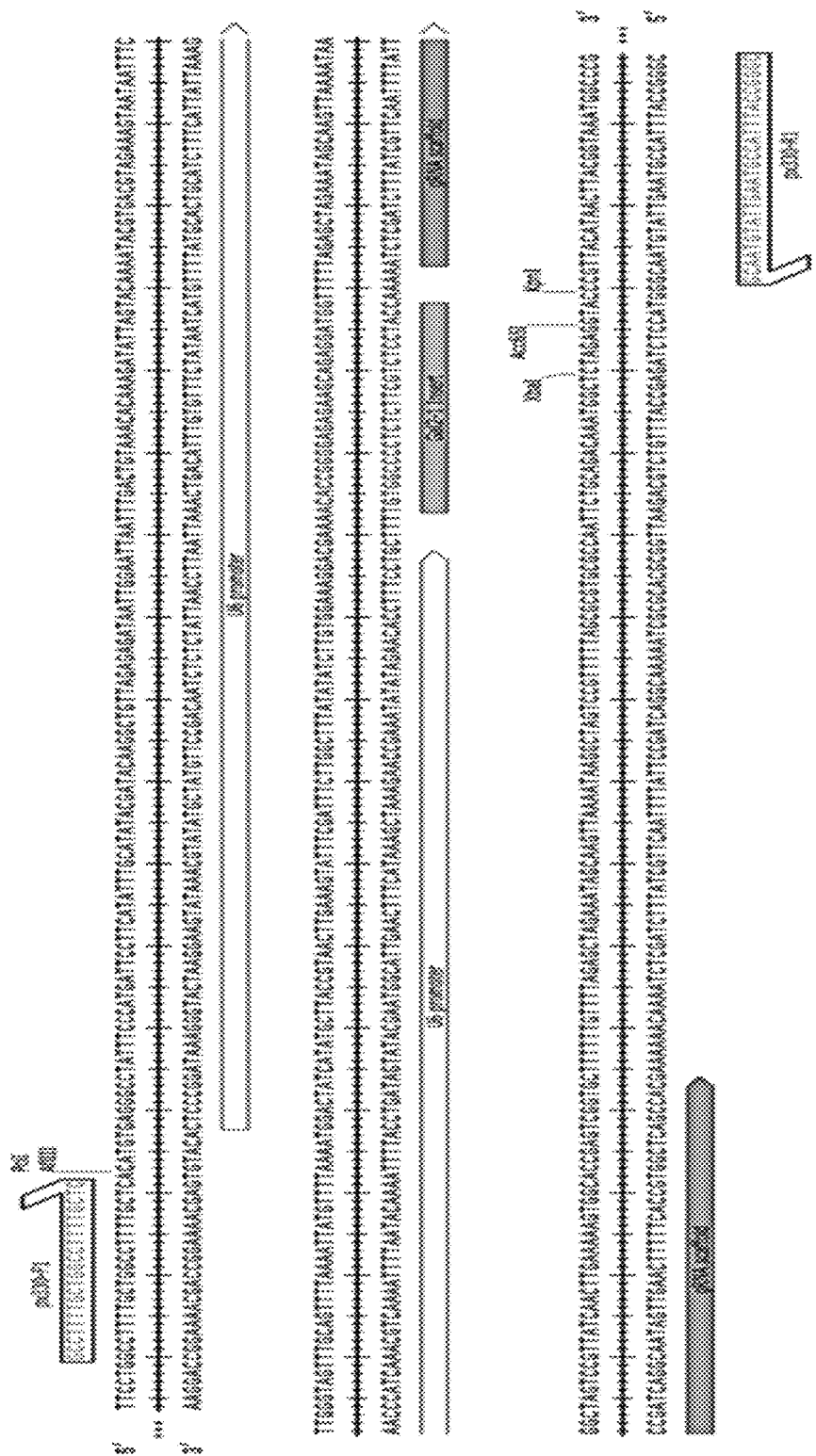
Figure 7E:
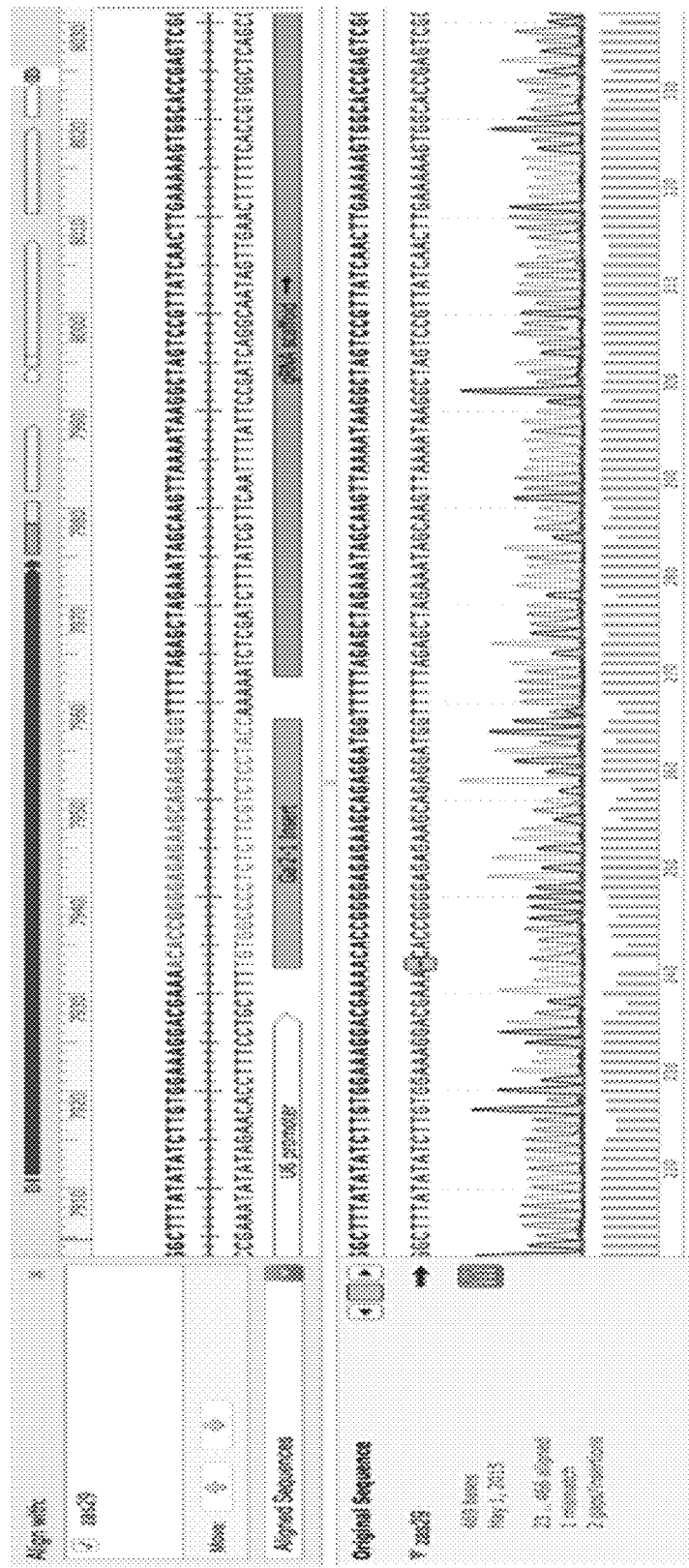
Figure 8A:
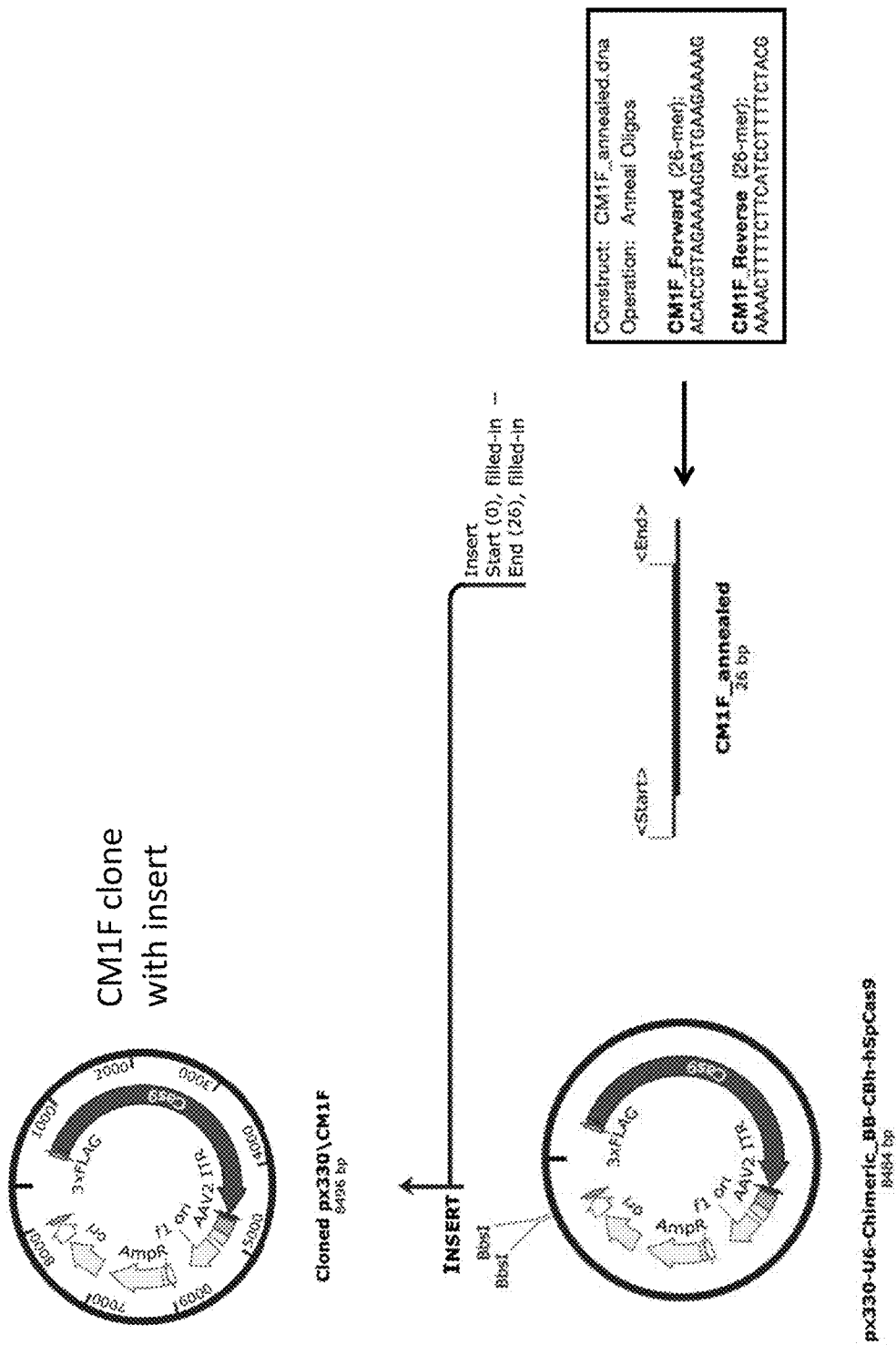
FIGS. 8A-8E demonstrate a strategy for cloning a px330-CM1F plasmid targeting CMAH.
Figure 8B:
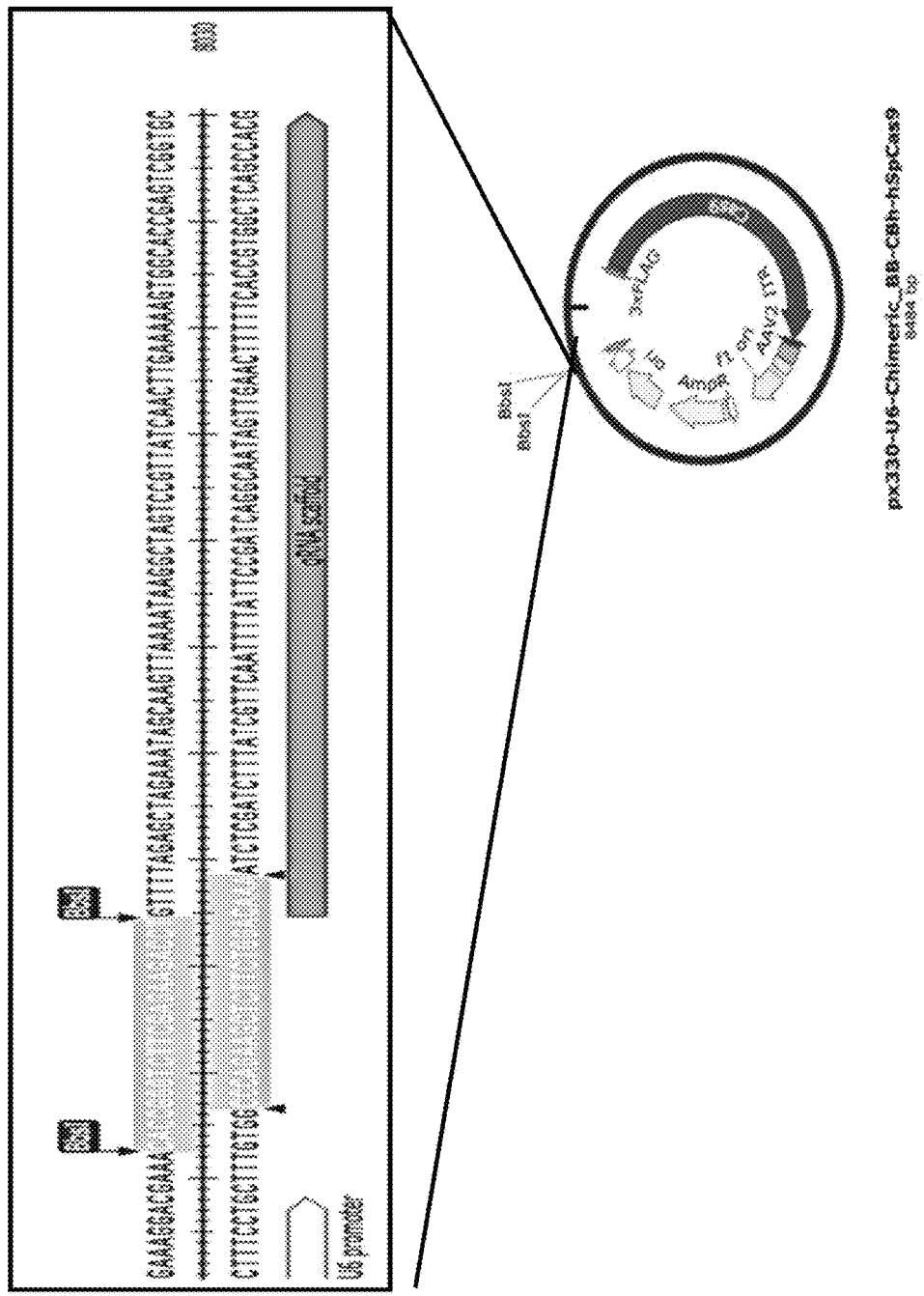
Figure 8C:
Figure 8D:
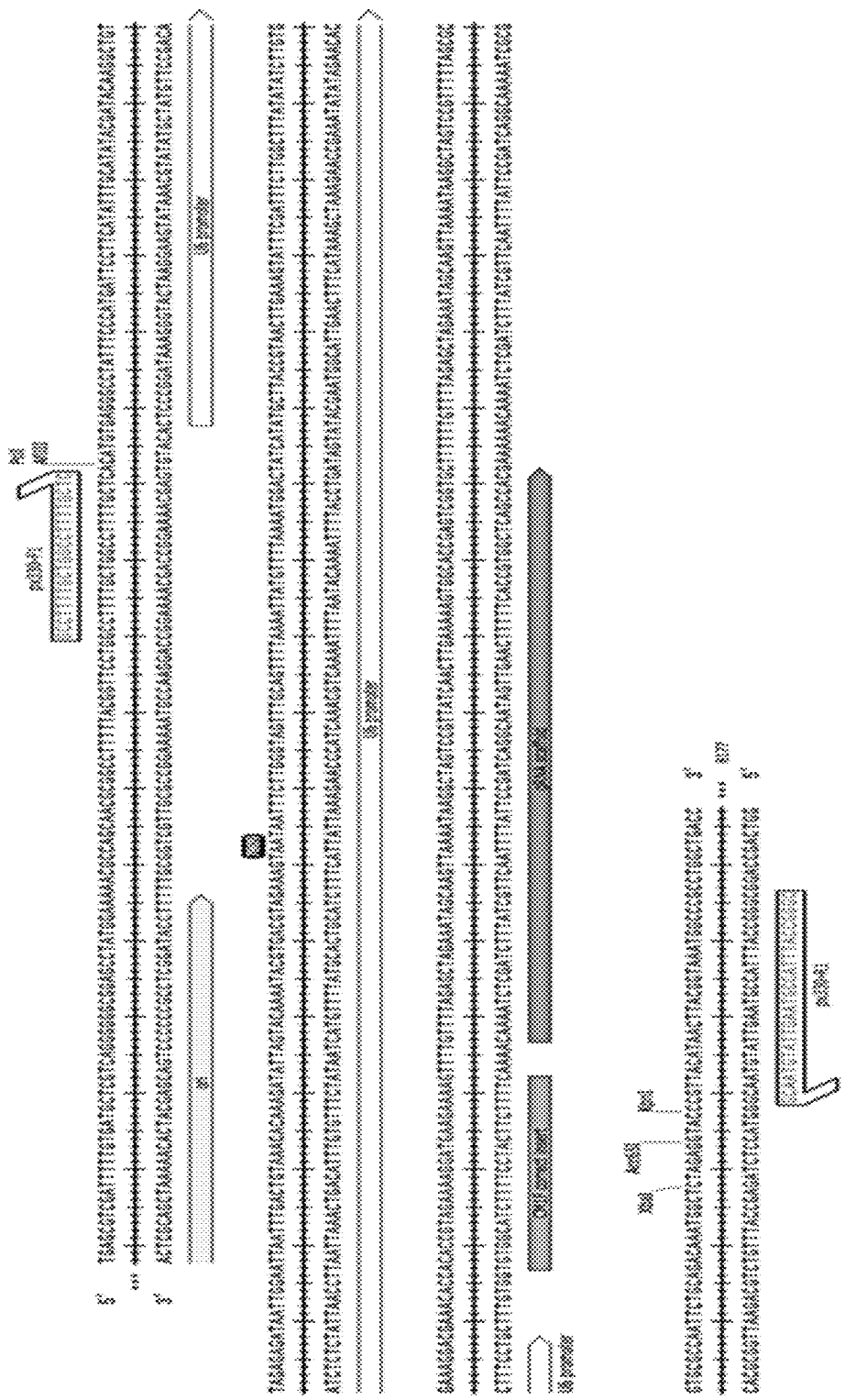
Figure 8E:
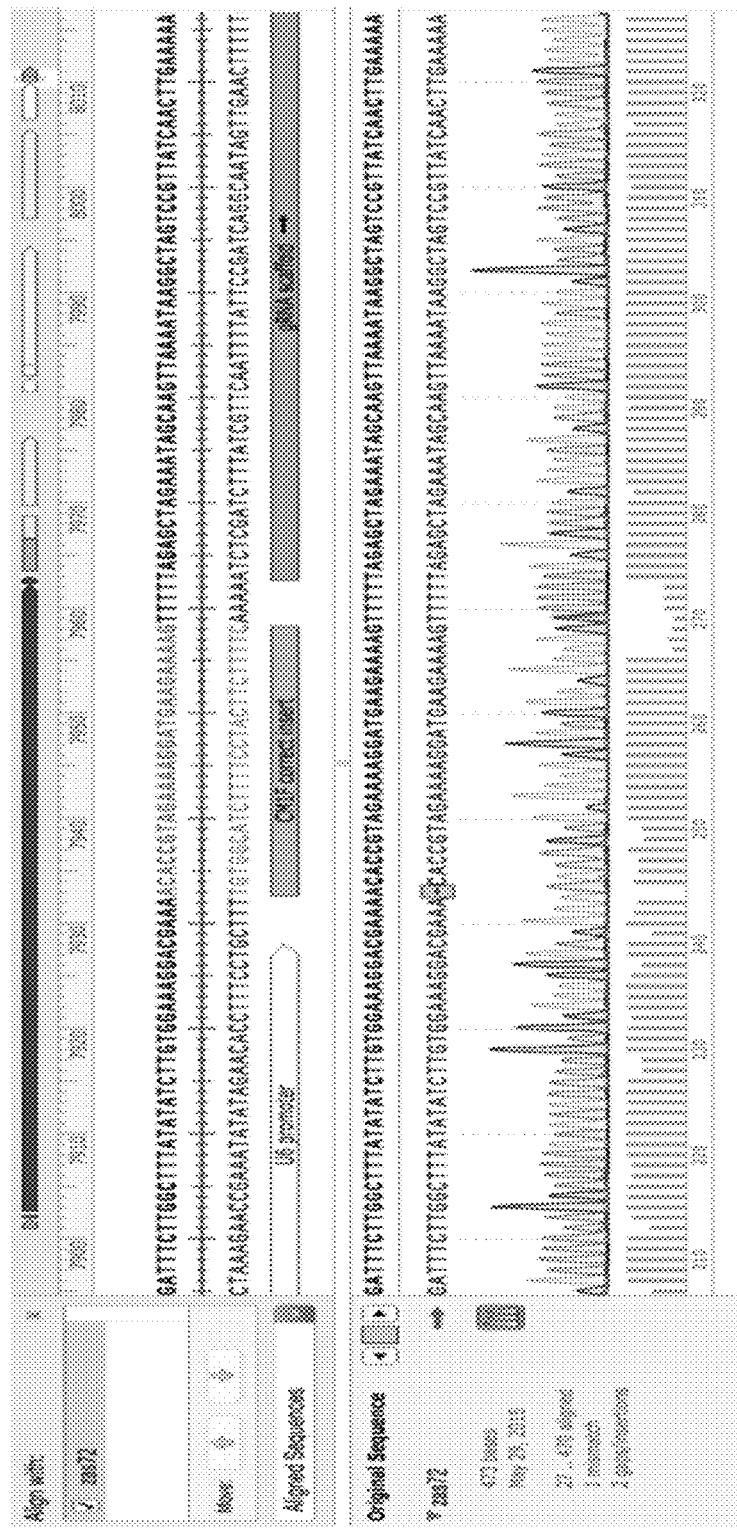
Figure 9A:
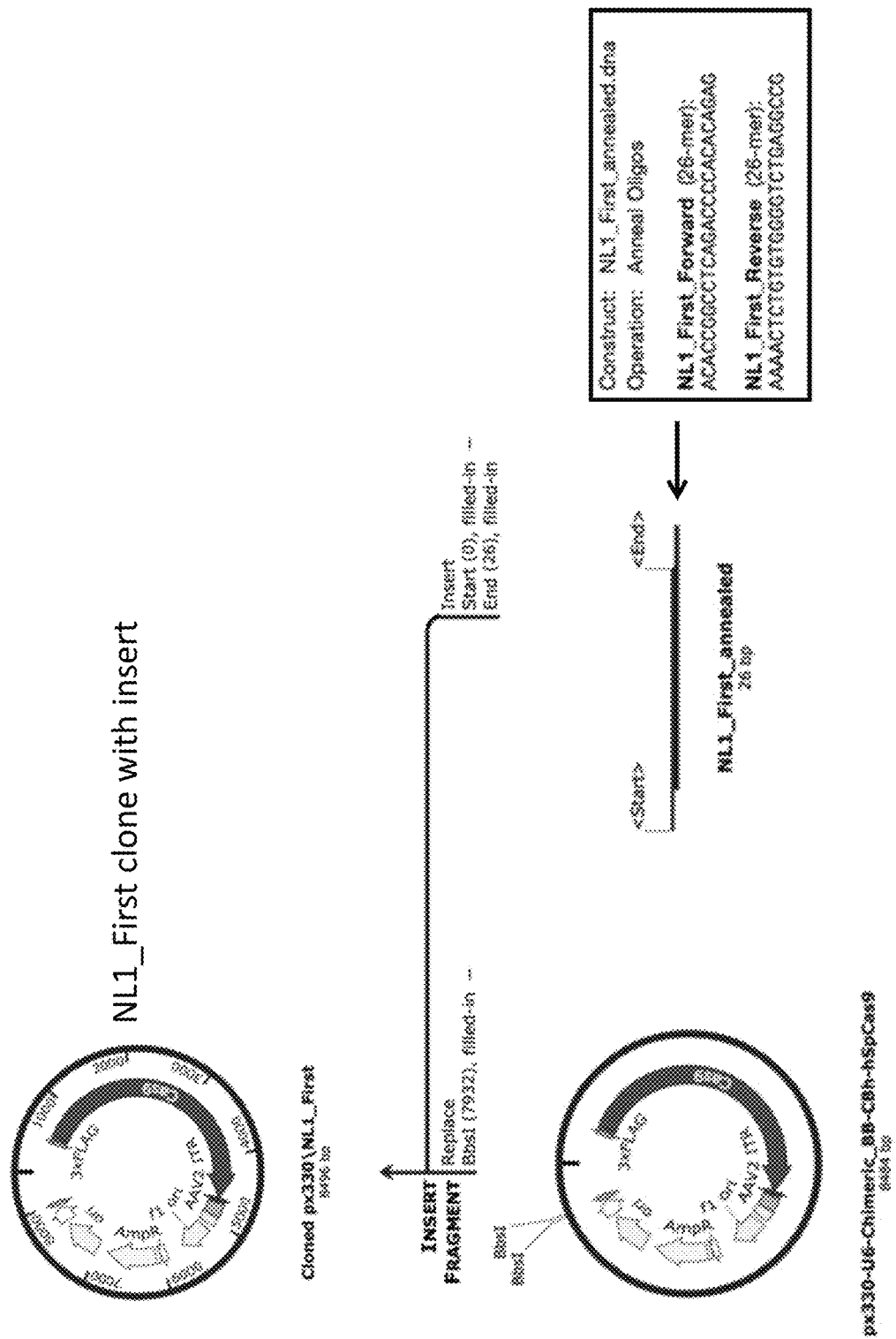
FIGS. 9A-9E demonstrate a strategy for cloning a px330-NL1_FIRST plasmid targeting NLRC5.
Figure 9B:
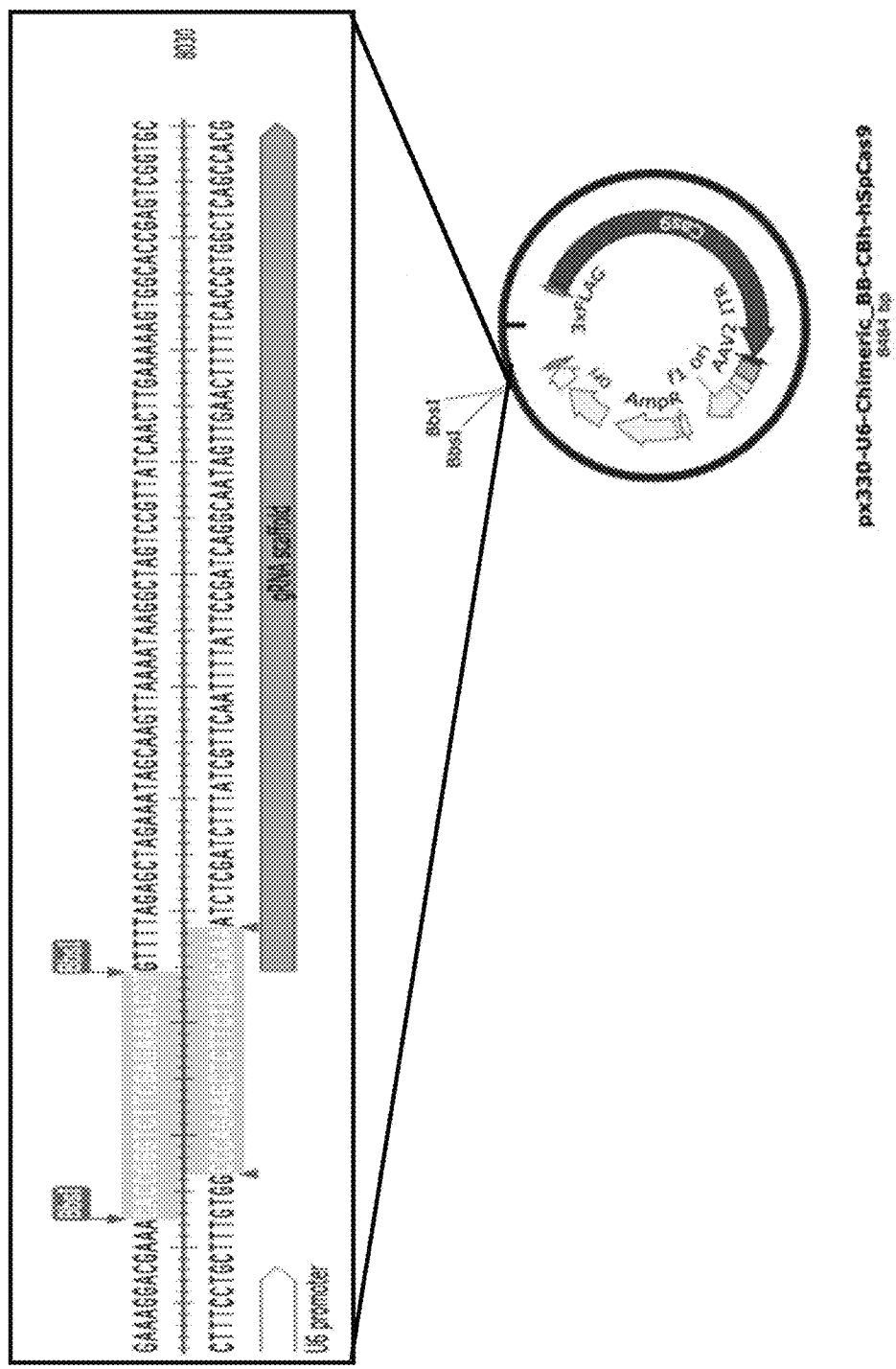
Figure 9C:
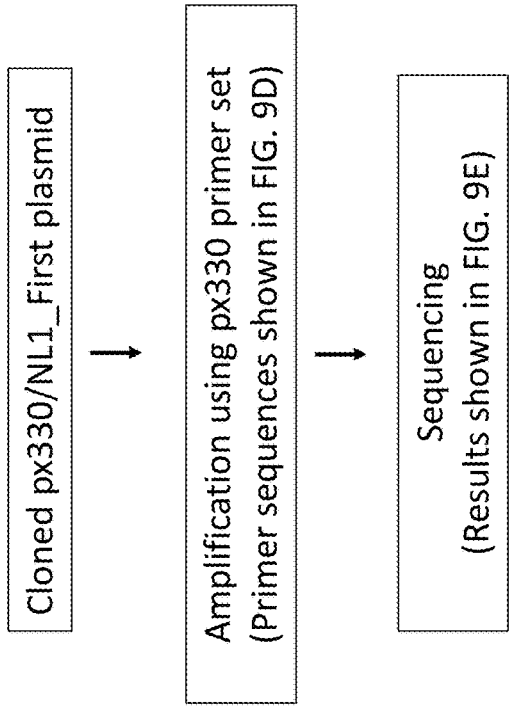
Figure 9D:
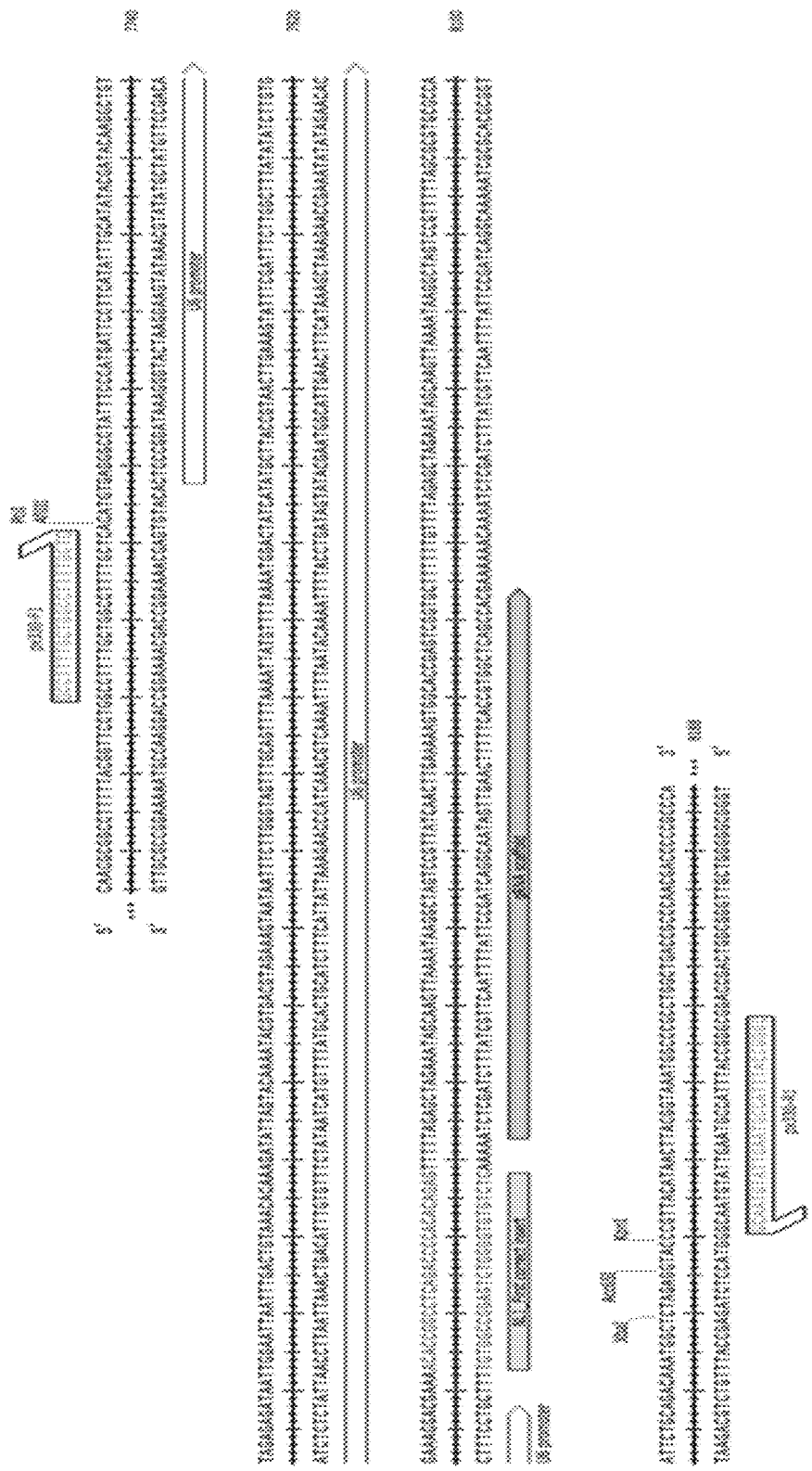
Figure 9E:
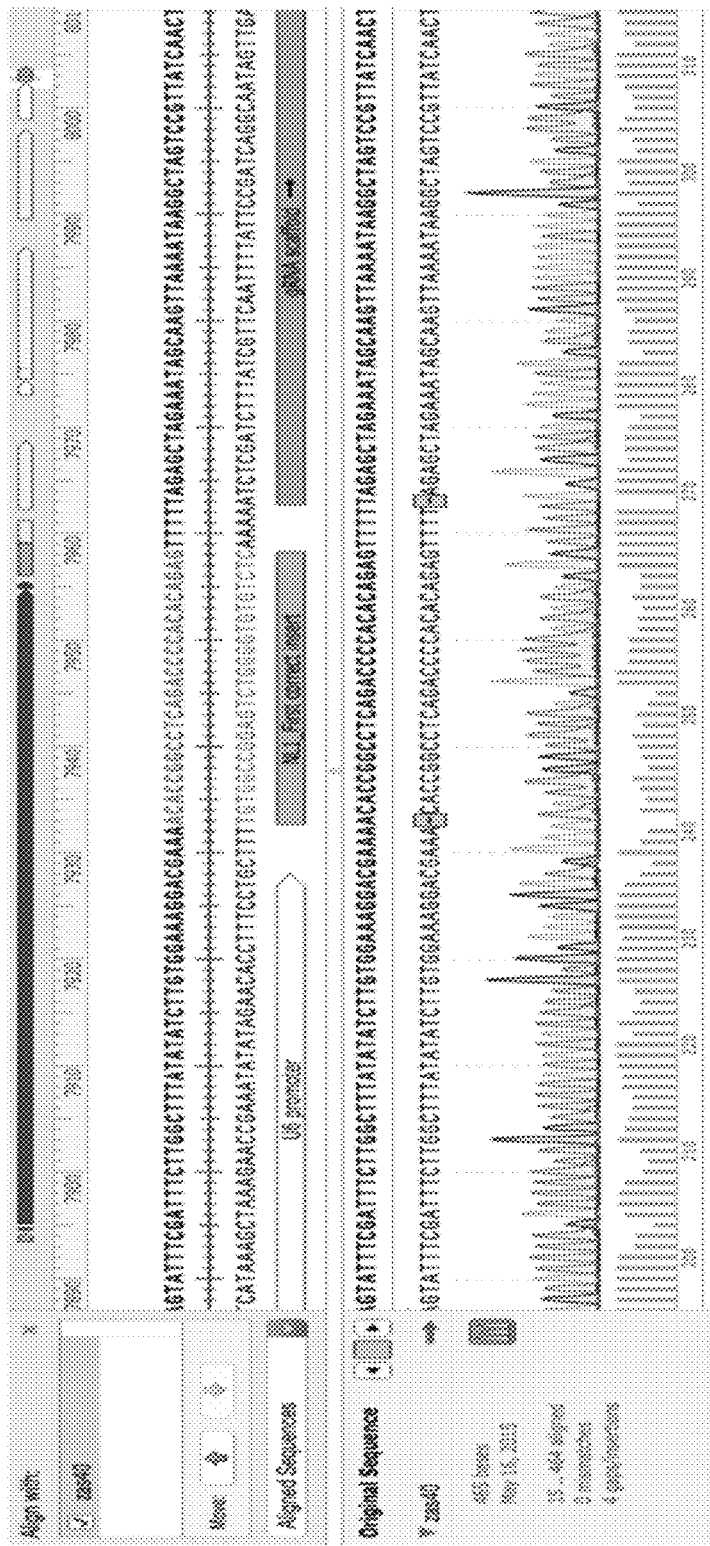
Figure 10A:
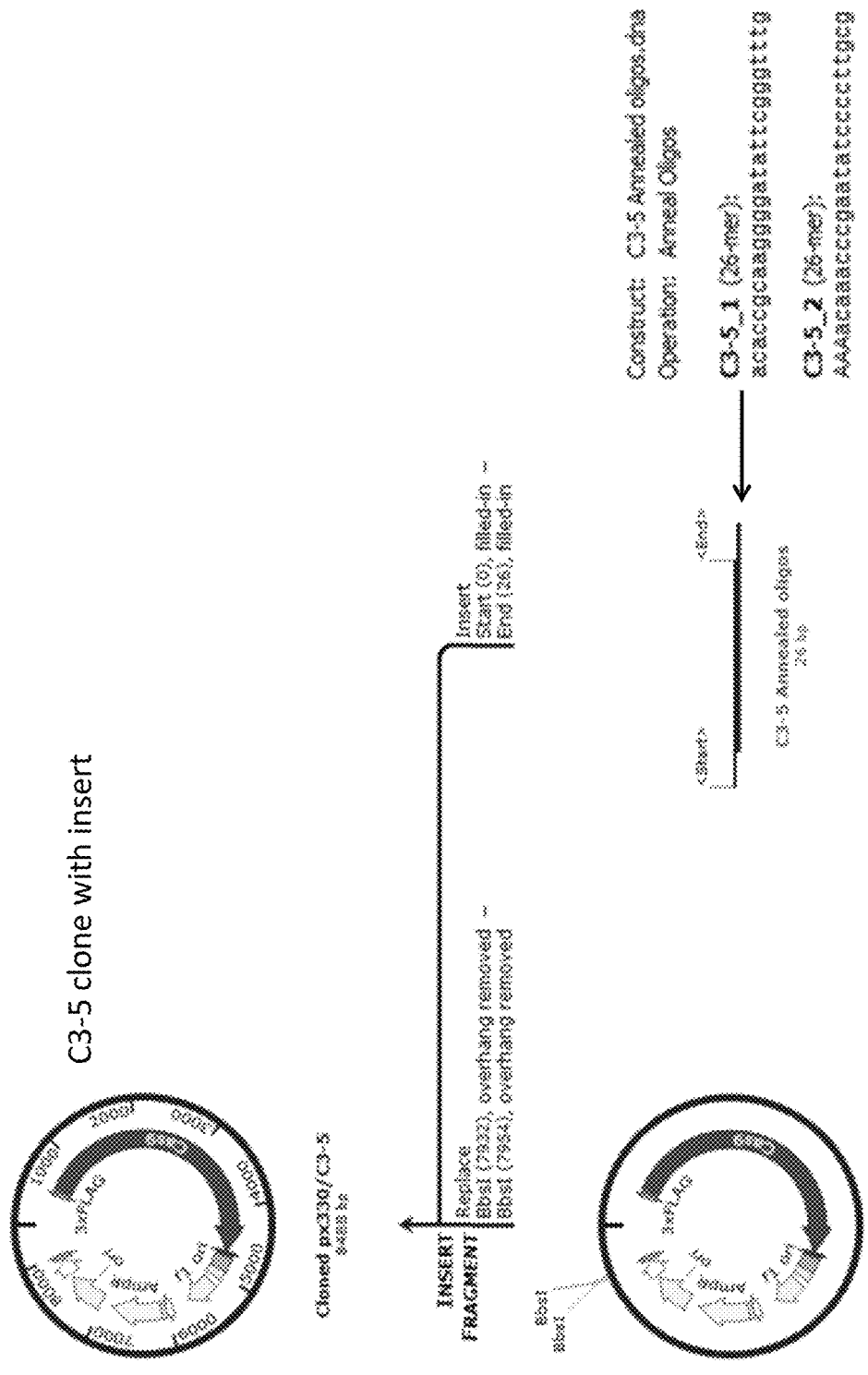
Figure 10B:
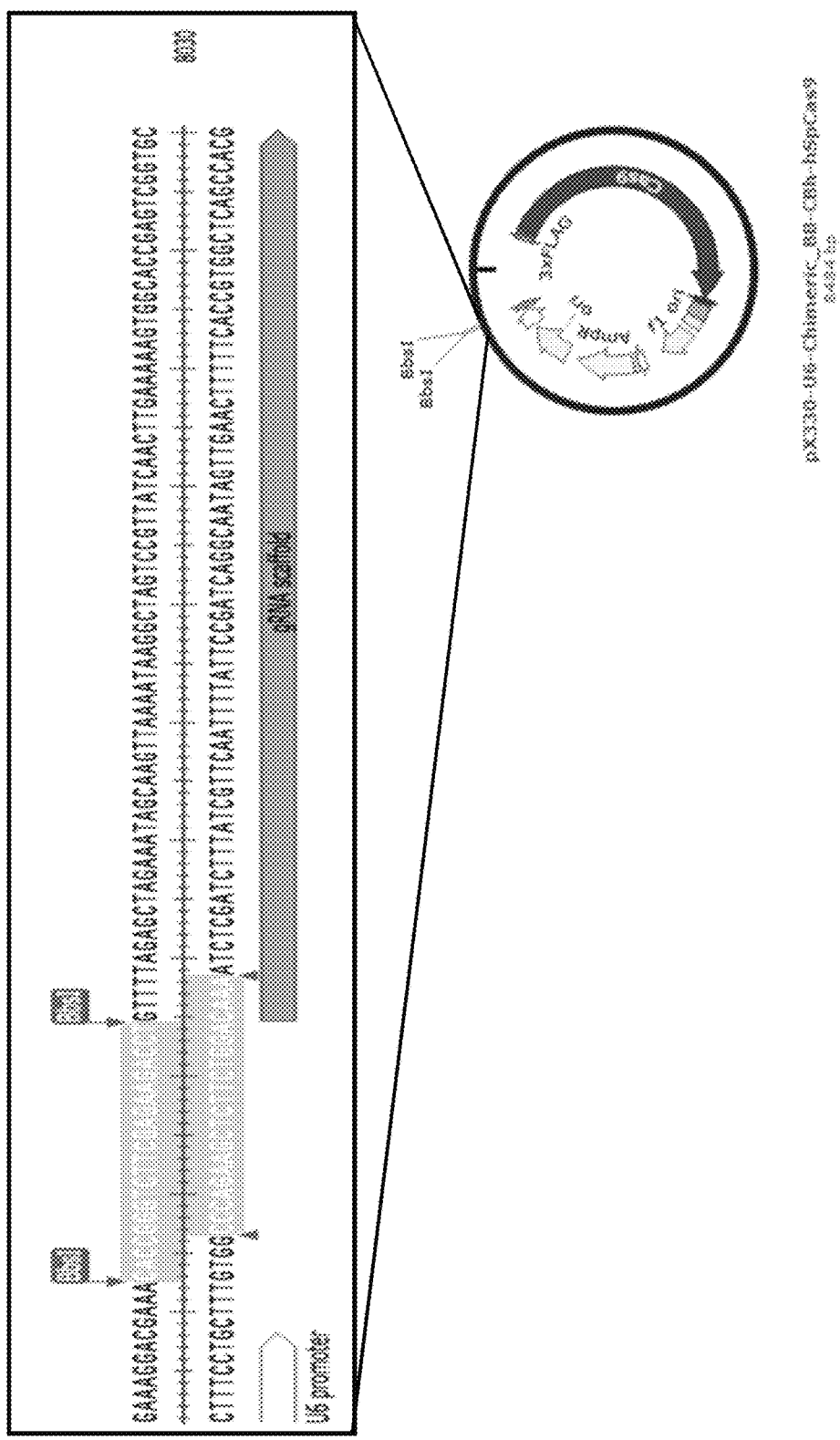
Figure 10C:
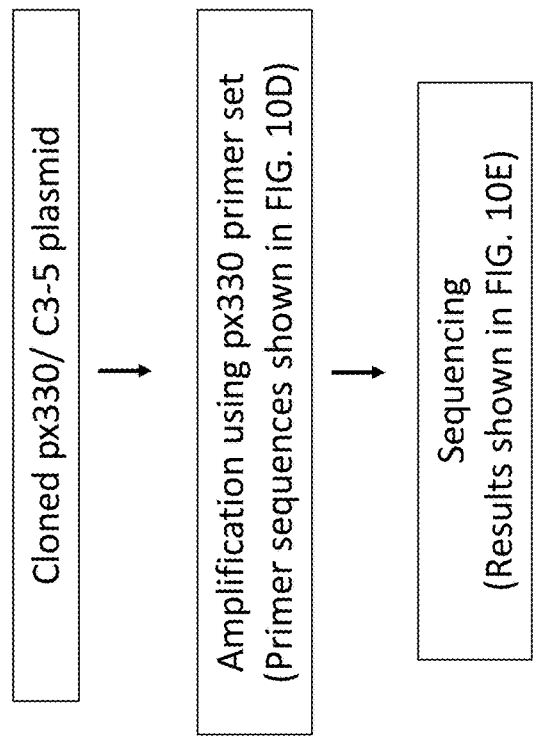
Figure 10E:
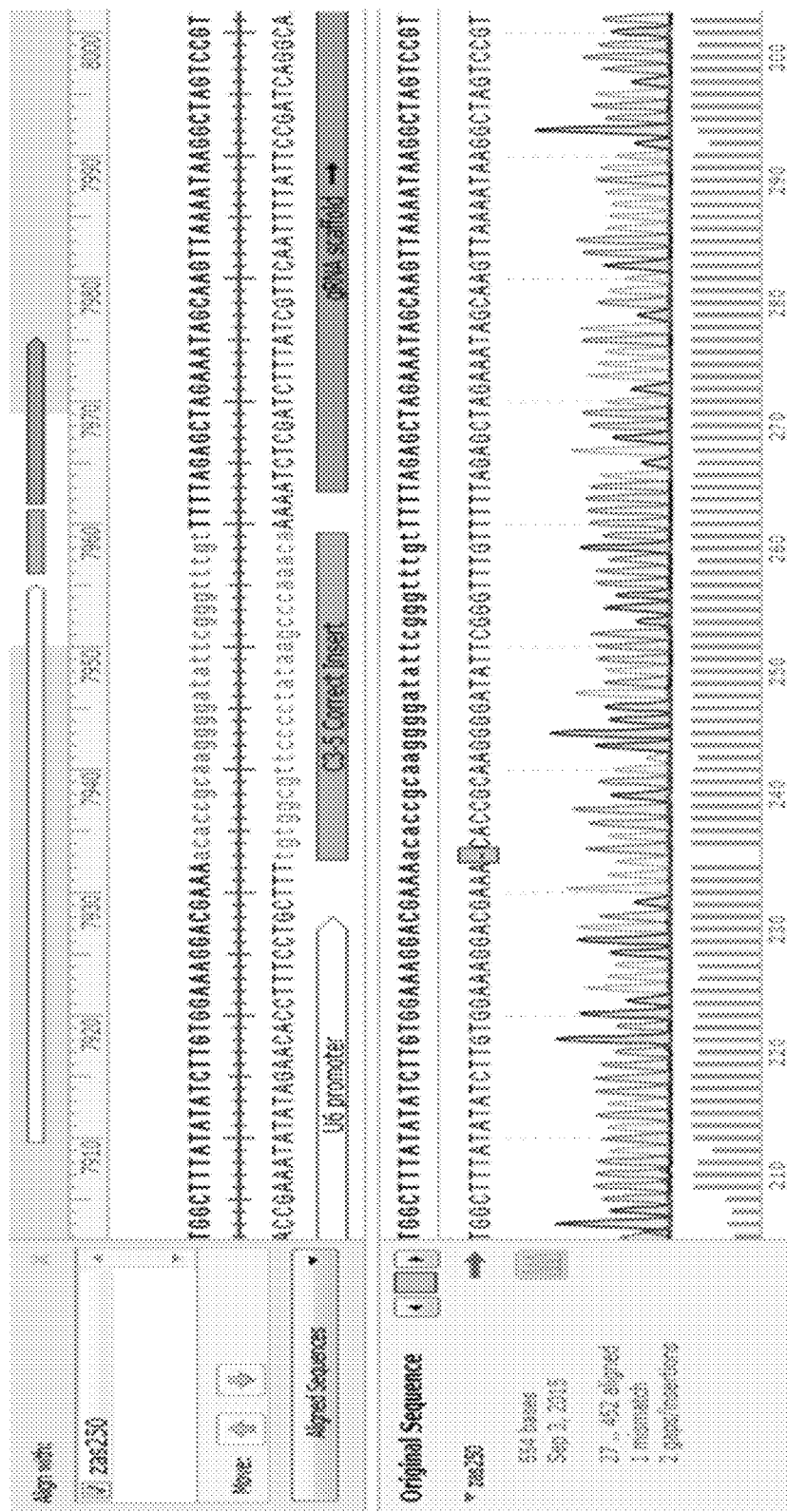
Figure 11A:
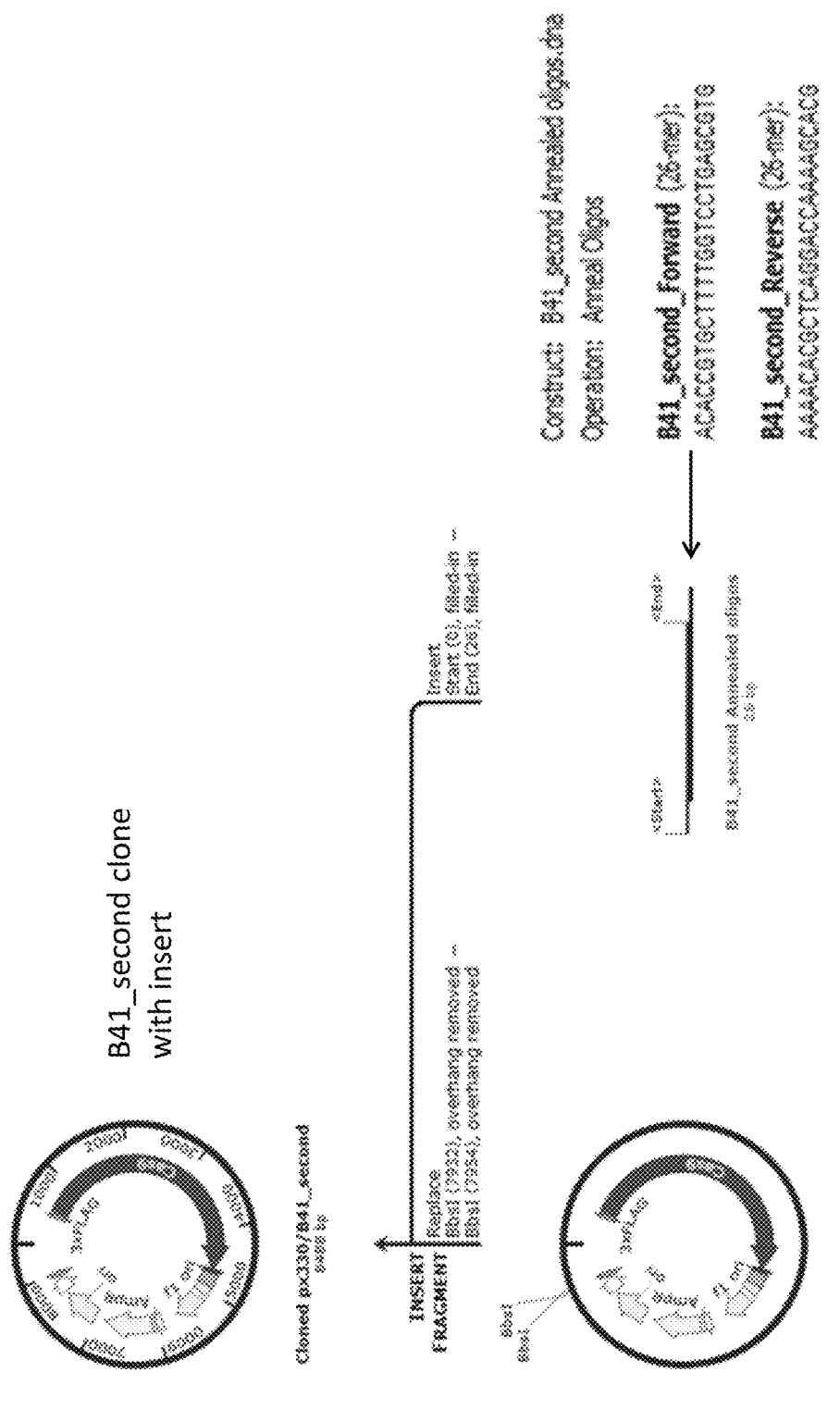
Figure 11B:
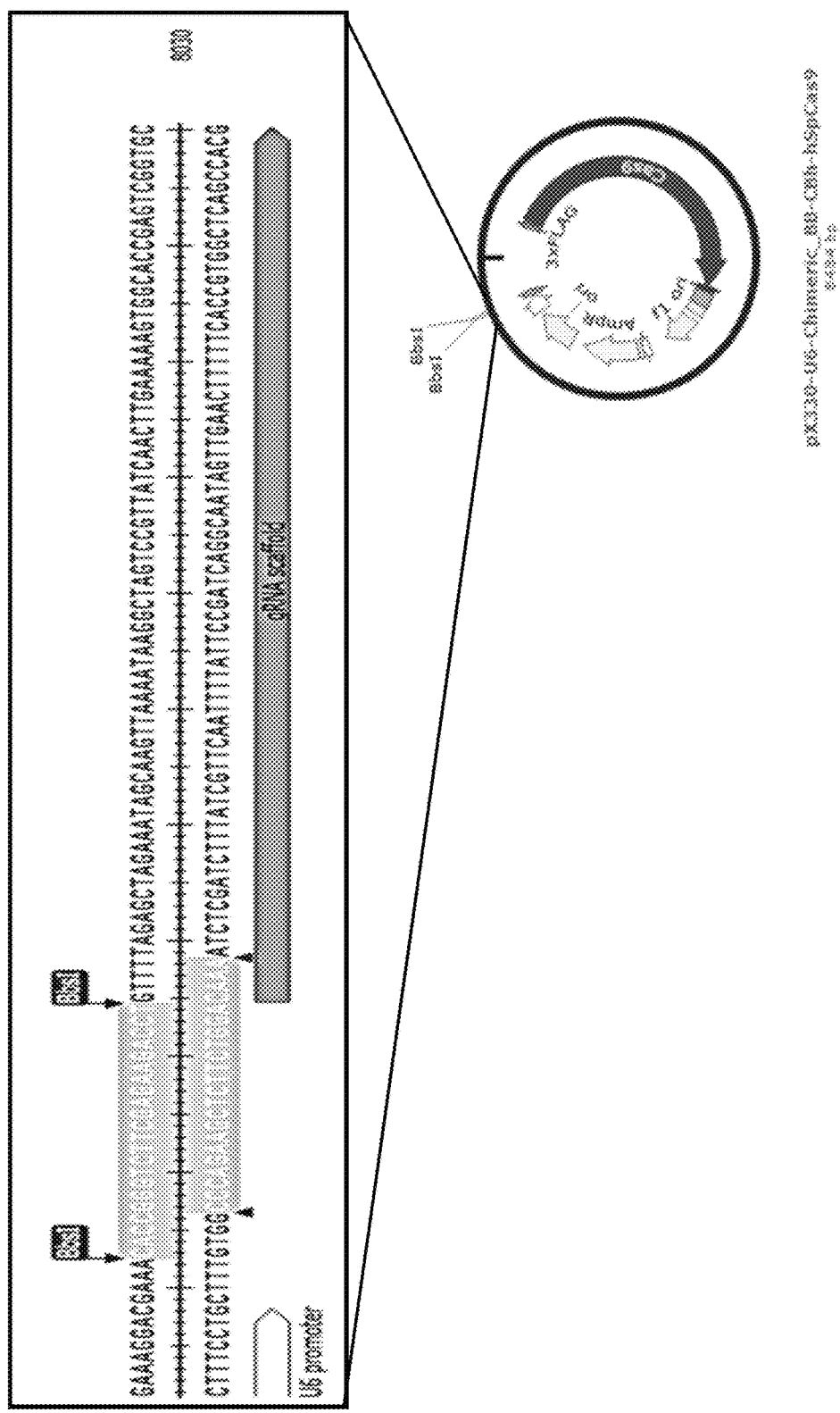
Figure 11C:
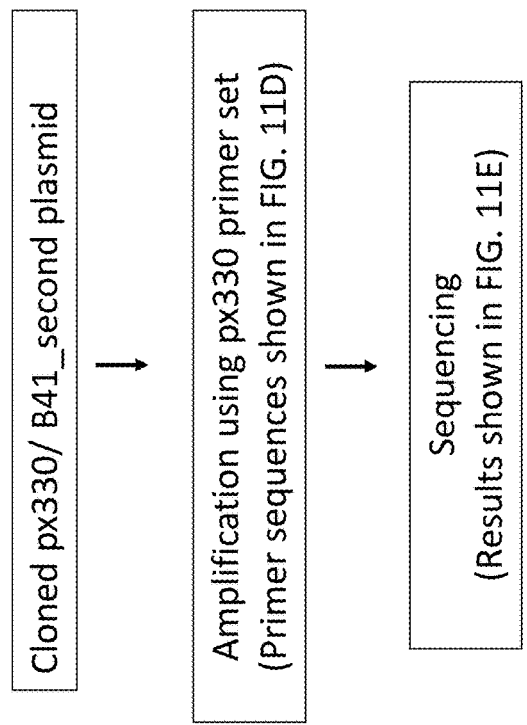
Figure 11E:
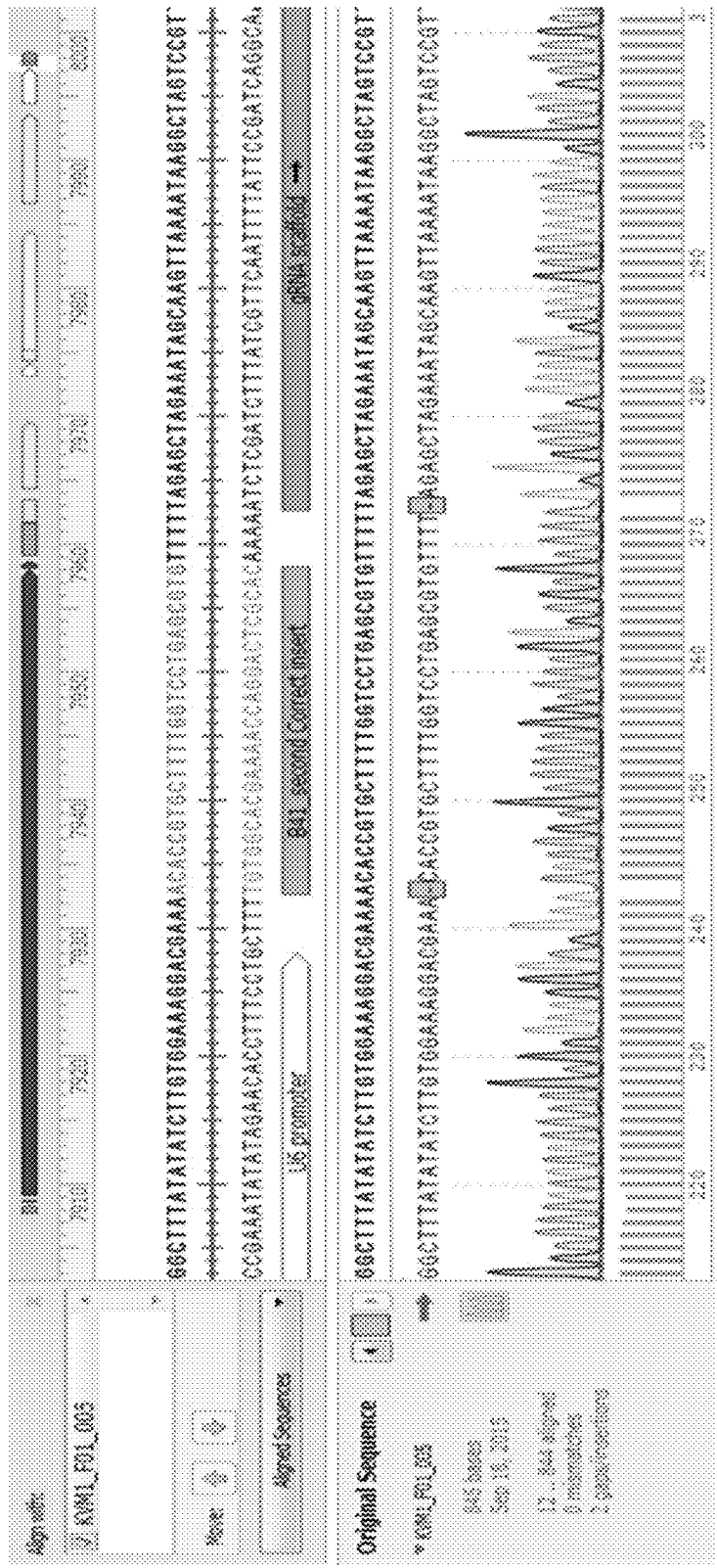

FIG. 6 demonstrates an exemplary protocol for transplant rejection prophylaxis in pig-to-cynomolgus monkey islet xenotransplantation. For a cynomolgus monkey transplanted with 25,000 islet equivalents/kg on day 0 (the day of transplantion), the protocol for transplant rejection prophylaxis can include: administering ECDI-fixed, apoptotic donor splenocytes on days −7 and 1, administering an α-CD40 (e.g., 2C10) 50 mg/kg on days −8, −1, 7, 14, administering an α-CD20 antibody (e.g., rituximab) 20 mg/kg on days −10, −3, 5, and 12, administering rapamycin (target trough 15-25 ng/mL), administering sTNFR (1 mg/kg on days −7 and 0, 0.5 mg/kg on days 3, 7, 10, 14, and 21), and administering an α-IL-6R antibody on days −7, 0, 7, 14, and 21 to the cynomolgus monkey.

EXAMPLES

Example 1

Generating Plasmids Expressing Guide RNA for Disrupting GGTA1, CMAH, NLRC5, B4GALNT2, and/or C3 Genes in Pigs Genetically modified pigs will provide transplant grafts that induce low or no immuno-rejection in a recipient, and/or cells as tolerizing vaccines that enhance immuno-tolerization in the recipient. Such pigs will have reduced expression of any genes that regulate MHC molecules (e.g., MHC I molecules and/or MHC II molecules) compared to a non-genetically modified counterpart animal. Reducing expression of such genes will result in reduced expression and/or function of WIC molecules. These genes will be one or more of the following: components of an MHC I-specific enhanceosome, transporters of a MHC I-binding peptide, natural killer group 2D ligands, CXCR 3 ligands, C3, and CIITA. Additionally or alternatively, such pigs will comprise reduced protein expression of an endogenous gene that is not expressed in human (e.g., CMAH, GGTA1 and/or B4GALNT2). For example, the pigs will comprise reduced protein expression of one or more of the following: NLRC5, TAP1, C3, CXCL10, MICA, MICB, CIITA, CMAH, GGTA1 and/or B4GALNT2. In some cases, pigs will comprise reduced protein expression of NLRC5, C3, CXCL10, CMAH, GGTA1 and/or B4GALNT2.

This example shows exemplary methods for generating plasmids for disrupting GGTA1, CMAH, NLRC5, B4GALNT2, and/or C3 genes in pigs using the CRISPR/cas9 system. The plasmids were generated using the px330 vector, which simultaneously expressed a Cas9 DNA endonuclease and a guide RNA.

The px330-U6-Chimeric_BB-CBh-hSpCas9 (#42230) plasmid was obtained from Addgene in a bacterial stab culture format. The stab culture was streaked onto a pre-warmed LB agar with ampicillin plate and incubated at 37° C. overnight. The next day, a single colony was selected and inoculated in a liquid LB overnight culture with ampicillin (5 mL for mini-prep, or 80-100 mL for maxi-prep). Mini-prep was performed using Qiagen kits according to manufacturer's instructions. Plasmid was eluted in nuclease free water and stocks were stored at −20° C. The oligonucleotides designed for targeting GGTA1, CMAH, NLRC5, C3, and B4GALNT2 are shown in Table 6. The oligonucleotides were synthesized by IDT. FIGS. 7A-7E, 8A-8E, 9A-9E, 10A-10E, and 11A-11E, show the cloning strategies for cloning plasmids targeting GGTA1 (i.e., px330/Gal2-1) (FIGS. 7A-7E), CMAH (i.e., px330/CM1F) (FIGS. 8A-8E), NLRC5 (i.e., px330/NL1_First) (FIGS. 9A-9E), C3 (i.e., px330/C3-5) (FIGS. 10A-10E), and B4GALNT2 (i.e., px330/B41_second) (FIGS. 11A-11E). The constructed px330 plasmids were validated by sequencing using sequencing primers shown in Table 7. Oligonucleotides were re-suspended at 100 μM with nuclease free water and stored in the −20° C. freezer.

Vector digestion: The px330 vectors were digested in a reaction solution containing 5 μg px330 stock, 5 μL 10× FastDigest Reaction Buffer, 35 μL nuclease free water, and 5 μL FastDigest BbsI enzyme (Cutsite: GAAGAC). The reaction solution was incubated at 37° C. for 15 minutes, the heat inactivated at 65° C. for 15 minutes. To desphosphorylate the vector, 0.2 μL (2 U; 1 U/1 pmol DNA ends) CIP was added and the resulting mixture was incubated at 37° C. for 60 minutes. The linearized plasmid was purified using Qiagen PCR Cleanup kit, and eluted with nuclease free water and stored at −20° C. until use.

Oligonucleotides Annealing and phosphorylation: a solution was made by mixing 1 μL 100 uM Forward oligonucleotide, 1 μL 100 uM Reverse oligonucleotide, 1 μL 10×T4 Ligase Buffer, 6 μL nuclease free water, 1 μL Polynucleotide Kinase (PNK). The resulting solution was incubated on a thermal cycler running the following program: 37° C. for 30 min, 95° C. for 5 min, ramp down to 25° C. at 0.1° C./second.

Ligation Reaction: a solution was made by mixing diluted annealed oligonucleotides 1:250 with nuclease free water, 2 μL diluted annealed oligonucleotides, 100 ng linearized/dephosphorylated px330 vector, 5 μL 10×T4 Ligase Buffer, nuclease free water to bring to 50 μL final volume, and 2.5 μL T4 DNA Ligase. The solution was incubated at room temp for 4 hours, then heat inactivated at 65° C. for 10 minutes.

Transformation: TOP10 E. coli vials were thawed from −80° C. freezer on ice for 15 minutes prior to transformation. 2 μL of the ligation reaction product was added to the cells and mixed by gently flicking the tubes. The tubes were incubated on ice for 5 minutes, heat shocked in 42° C. water bath for 30 seconds, and placed back on ice for additional 2 minutes after heat shock. 50 μL of transformed cells were plated onto an LB agar with ampicillin plate and spread with pipette tip. The plates were incubated at 37° C. overnight.

Colony PCR screening for correctly inserted oligonucleotides: 3× colonies were selected from the plate and labeled 1-3 on bottom of plate. Master mix for PCR reaction was prepared by mixing 15 μL 10× Standard Taq Reaction Buffer, 3 μL 10 mM dNTP mix, 0.5 μL 100 uM px330-F1 primer (SEQ ID No. 125 in Table 7), 0.5 μL 100 uM px330-R1 primer (SEQ ID No. 126 in Table 7), 130 μL nuclease free water, and 1 μL Standard Taq Polymerase. Master mix was vortexed briefly, then aliquotted 50 μL to 3×PCR tubes labeled 1-3. A pipette tip was dabbed into colony #1 on the agar plate and then pipetted up and down in PCR tube #1. Repeated for each colony being screened using a fresh tip for each colony. Tubes were placed in thermal cycler to run the following program: 95° C. for 5 min, 95° C. for 30 seconds, 52° C. for 30 seconds, 68° C. for 30 seconds, cycle step 2-4 for 30 cycles, 68° C. for 5 min, hold at 4° C. until use. PCR Cleanup was performed using Qiagen PCR Cleanup Kit and followed manufacturer's protocol. The product was eluted in nuclease free water.

Preparing samples for sequencing: a solution was made by mixing 120 ng PCR product, 6.4 pmols px330-F1 primer (1 μL of 6.4 μM stock), and nuclease free water that brought the final volume to 12 μL. After the sequence data was obtained, correct sequence inserts were identified. Glycerol stocks of colonies with correct inserts were prepared. On the LB agar plate labeled during colony PCR with #1-3, the correctly inserted colonies were inoculated in 5 mL LB medium with ampicillin by dabbing with a pipette tip and ejecting into the tube of medium. Liquid culture was grown out until an OD was reached between 1.0 and 1.4. 500 μL of bacterial culture was added to 500 μL of sterile 50% glycerol in a cryovial and placed immediately on dry ice until transfer to −80° C. freezer.

TABLE 6

Exemplary oligonucleotides for making guide RNA constructs targeting GGTA1, CMAH, NLRC5, C3, and B4GALNT2

| Gene | SEQ ID No. | Forward sequence (5' to 3') | SEQ ID No. | Reverse sequence (5' to 3') |
| --- | --- | --- | --- | --- |
| C3 | 113 | acaccgcaagggatattcgggtttg | 114 | aaaacaaacccgaatatcccttgcg |
| B4GALNT2 (option1) | 115 | acaccgtgcttttggtcctgagcgtg | 116 | aaaacacgctcaggaccaaaagcacg |

TABLE 6-continued

Exemplary oligonucleotides for making guide RNA constructs targeting GGTA1, CMAH, NLRC5, C3, and B4GALNT2

| Gene | SEQ ID No. | Forward sequence (5' to 3') | SEQ ID No. | Reverse sequence (5' to 3') |
|---|---|---|---|---|
| B4GALNT2 (option2) | 117 | acaccgtcgatcctcaagatattgag | 118 | aaaactcaatatcttgaggatcgacg |
| GGTA1 | 119 | acaccggggagagaagcagaggatgg | 120 | aaaaccatcctctgcttctctccccg |
| CMAH | 121 | acaccgtagaaaaggatgaagaaaag | 122 | aaaacttttcttcatccttttctacg |
| NLRC5 | 123 | acaccggcctcagaccccacacagag | 124 | aaaactctgtgtggggtctgaggccg |

TABLE 7

Exemplary sequencing primers for px330 plasmids

| SEQ ID No. | Forward sequence (5' to 3') | SEQ ID No. | Reverse sequence (5' to 3') |
|---|---|---|---|
| 125 | gcctttgctggccttttgctc | 126 | cgggccatttaccgtaagttatgtaacg |

Example 2

Generating a Plasmid Expressing Guide RNA Targeting the Rosa26 Locus in Pigs Pigs with MHC deficiencies will provide transplant grafts that induce low or no immuno-rejection in a recipient. Exogenous proteins that inhibit MHC functions will be expressed in pigs to cause MHC deficiencies. Another goal of ours further along in the project is to insert one or more exogenous polynucleotides encoding one or more proteins under the control of a ubiquitous promoter that will direct ubiquitous expression of the one or more proteins. This example show generating a plasmid expressing guide RNA targeting one of such ubiquitous promoter, Rosa26. Rosa26 promoter will direct ubiquitous expression of a gene at the Rosa26 locus. Thus transgenic pigs will be generated by inserting transgenes encoding the exogenous proteins at the Rosa26 locus, so that the gene product will be expressed in all cells in the pig. A plasmid expressing guide RNA targeting Rosa26 will be used to facilitate insertion of a transgene into the Rosa26 locus. This example shows exemplary methods for generating plasmids for targeting the Rosa26 locus in pigs using the CRISPR/cas9 system. The plasmids were generated using the px330 vector, which was be used to simultaneously express a Cas9 DNA endonuclease and a guide RNA.

Sequencing Rosa26:

For designing guide RNA targeting Rosa26 locus in a pig, Rosa26 in the pig was sequenced to provide accurate sequence information.

Primer Design: The Rosa26 reference sequence utilized to generate primers was taken from Kong et. al., *Rosa26 Locus Supports Tissue-Specific Promoter Driving Transgene Expression Specifically in Pig*. PLoS ONE 2014; 9(9): e107945, Li et. al., *Rosa26-targeted swine models for stable gene over-expression and Cre-mediated lineage tracing*. Cell Research 2014; 24(4):501-504, and Li et. al., *Identification and cloning of the porcine ROSA26 promoter and its role in transgenesis*. Transplantation Technology 2014;2(1).

The reference sequence was then expanded by searching the pig genome database (NCBI) and by using Ensembl Genome Browser. The base sequence was separated into four 1218 base pair regions to facilitate primer design. Primers were designed using Integrated DNA Technologies' PrimerQuest Tool and then searched against the *Sus scrofa* reference genomic sequences using Standard Nucleotide BLAST to check for specificity. Primer length was limited to 200-250 base pairs. Primer annealing temperature was calculated using the New England Tm Calculator for a primer concentration of 1000 nM and the Taq DNA Polymerase Kit.

PCR: PCR was performed using Taq DNA Polymerase with Standard Taq Buffer (New England Biolabs). DNA template used for the PCR was extracted from cells isolated from the cloned pig. PCR conditions were 30 cycles of: 95° C., 30 seconds; 50° C., 30 seconds, 51° C. 30 seconds, 52° C. 30 seconds, 53° C. 30 seconds, 54° C. 30 seconds, 55° C. 30 seconds; and an extension step at 68° for 30 seconds. PCR products were purified using the QIAquick PCR Purification Kit (Qiagen). Primers used for sequencing are listed in Table 8.

TABLE 8

Exemplary PCR primers for sequencing Rosa26

| SEQ ID No. | Primer Name | Sequence (from 5' to 3') |
|---|---|---|
| 127 | R26F008 | tctgattggctgctgaagtc |
| 128 | R26F013 | gtagccagcaagtcatgaaatc |
| 129 | R26R013 | gggagtattgctgaacctca |
| 130 | R26F014 | tcttgactaccactgcgattg |
| 131 | R26R014 | gttaggagccagtaatggagtt |
| 132 | R26F015 | agtgtctctgtctccagtatct |
| 133 | R26R015 | ttggtaaatagcaatcaactcagtg |
| 134 | R26F016 | tttctgctcaagtcacactga |
| 135 | R26R016 | caagcaatgacaacaacctgata |

TABLE 8-continued

Exemplary PCR primers for sequencing Rosa26

| SEQ ID No. | Primer Name | Sequence (from 5' to 3') |
|---|---|---|
| 136 | R26F017 | ttgctttctcctgatcccatag |
| 137 | R26R017 | cagtgctaatctagagcactacc |
| 138 | R26F018 | cattctcctgaagagctcagaat |
| 139 | R26R018 | tccattgggctttgtctatactt |
| 140 | R26F019 | gacaaaggaaattagcagagaacc |
| 141 | R26R019 | aactggtctttccttggatatt |
| 142 | R26F020 | ctggctgcagcatcaatatc |
| 143 | R26R020 | gcctctattaattgcctttccc |
| 144 | R26F021 | ccattcacttcgcatccct |
| 145 | R26F005 | cgggaagtcgggagcata |
| 146 | R26R005 | gaggagaagcggccaatc |
| 147 | R26F006 | ctgctcttctcttgtcactgatt |
| 148 | R26R006 | gcgggagccactttcac |
| 149 | R26F008 | tctgattggctgctgaagtc |
| 150 | R26R008 | cgagagcaggtagagctagt |
| 151 | R26F010 | ggagtgccgcaataccttta |
| 152 | R26R010 | cctggactcatttcccatctc |
| 153 | R26F011 | gggtggagatgggaaatgag |
| 154 | R26F012 | gctacaccaccaaagtatagca |
| 155 | R26R012 | tggtggtggaacttatctgattt |
| 156 | R26F023 | aggggtacacattctcctga |
| 157 | R26R023 | gacctctgggttccattggg |
| 158 | R26F024 | caaagcccaatggaacccag |
| 159 | R26F025 | gaagggctttcccaacagt |
| 160 | R26F026 | gcccaagacagggaaaacga |
| 161 | R26R026 | tgacaactctggtcgctctg |
| 162 | R26F028 | cagagagcctcggctaggta |
| 163 | R26R028 | aatggctccgtccgtattcc |
| 164 | R26F029 | gggaagtcgggagcatatcg |
| 165 | R26R029 | cactcccgaggctgtaactg |
| 166 | R26F030 | atggcgtgttttggttggag |
| 167 | R26R030 | ggagccactttcactgaccc |
| 168 | R26F031 | gggagggtcagtgaaagtgg |
| 169 | R26R031 | gagggccgtaccaaagacc |
| 170 | R26F032 | ggtcccaaatgagcgaaacc |
| 171 | R26R032 | gggtccgagagcaggtagag |
| 172 | R26F033 | ccgcctgaaggacgagacta |
| 173 | R26R033 | cagggcggtccttaggaaaa |
| 174 | R26F034 | gggagtgccgcaataccttt |
| 175 | R26R034 | gaaattgggctcgtcctcgt |
| 176 | R26F035 | cgaggacgagcccaatttct |
| 177 | R26R035 | agtgaggggcctaaggtttt |
| 178 | R26F037 | actaccactgcgattggacc |
| 179 | R26R037 | aggagccagtaatggagttgt |
| 180 | R26F038 | cacaactccattactggctcct |
| 181 | R26R038 | ggagggtagcattccagagg |
| 182 | R26F021 | ccattcacttcgcatccct |
| 183 | R26R021 | ttgcagatgattgcttcctttc |
| 184 | R26F023 | aggggtacacattctcctga |
| 185 | R26R023 | gacctctgggttccattggg |
| 186 | R26F025 | gaagggctttcccaacagt |
| 187 | R26R025 | gtggcgtatgcccagtatc |

Figure 12:
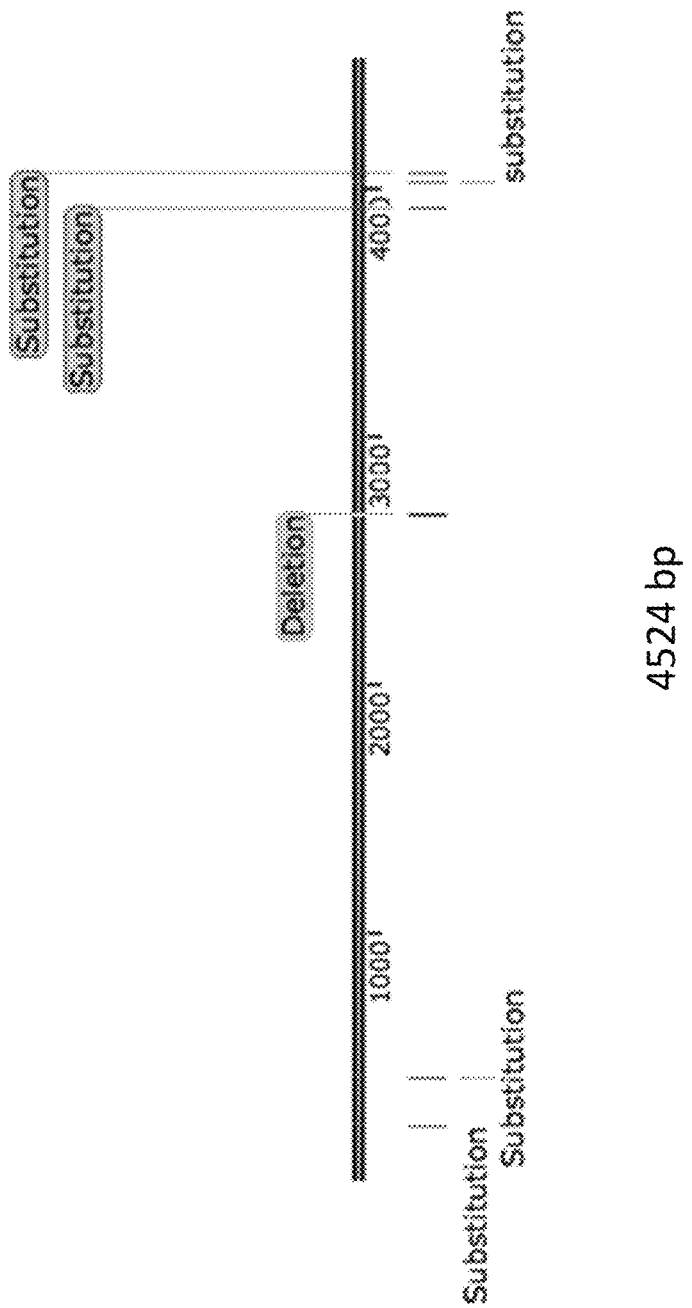
FIG. 12 demonstrates a map of Rosa26 locus sequenced in Example 2.
Figure 13A:
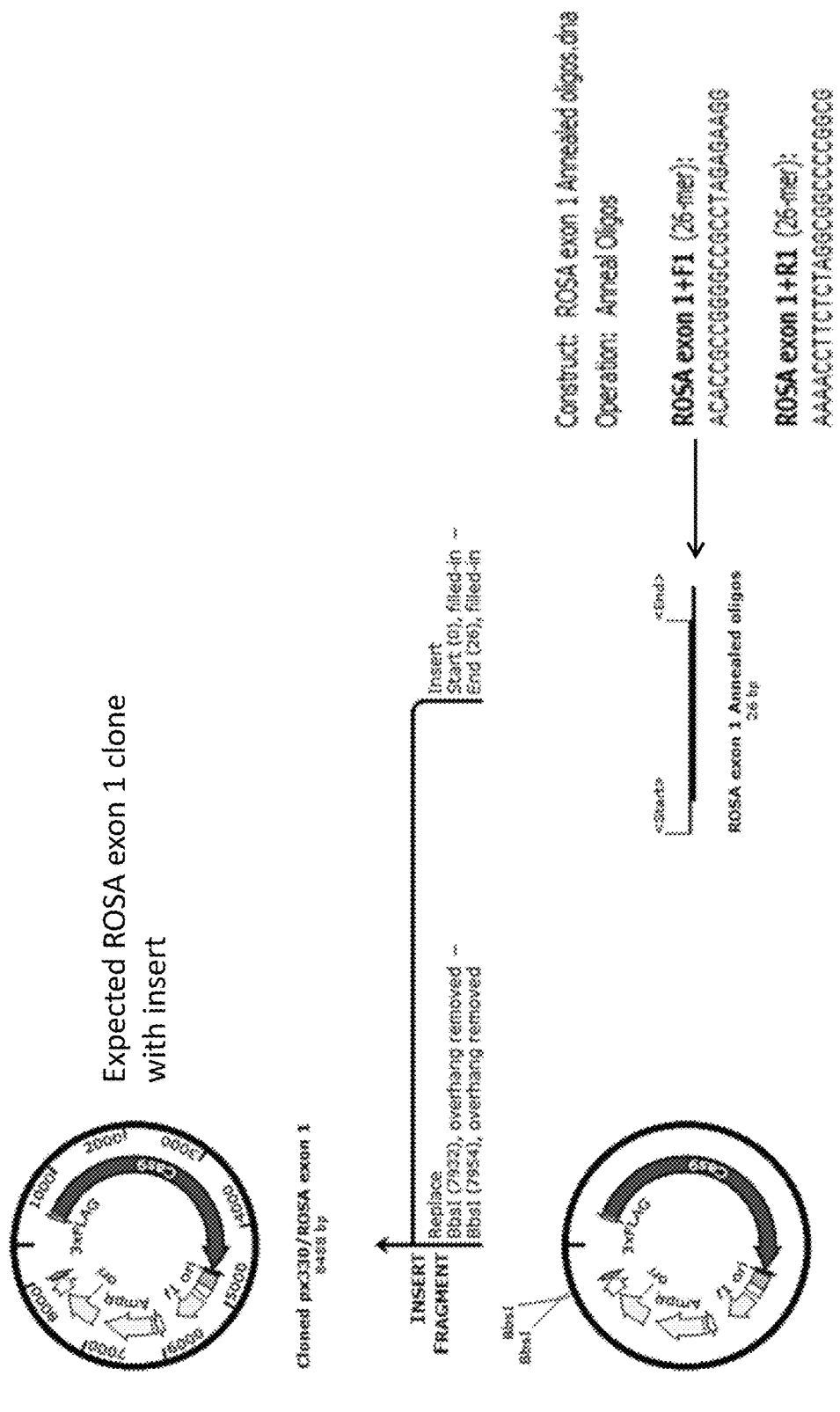
Figure 13B:
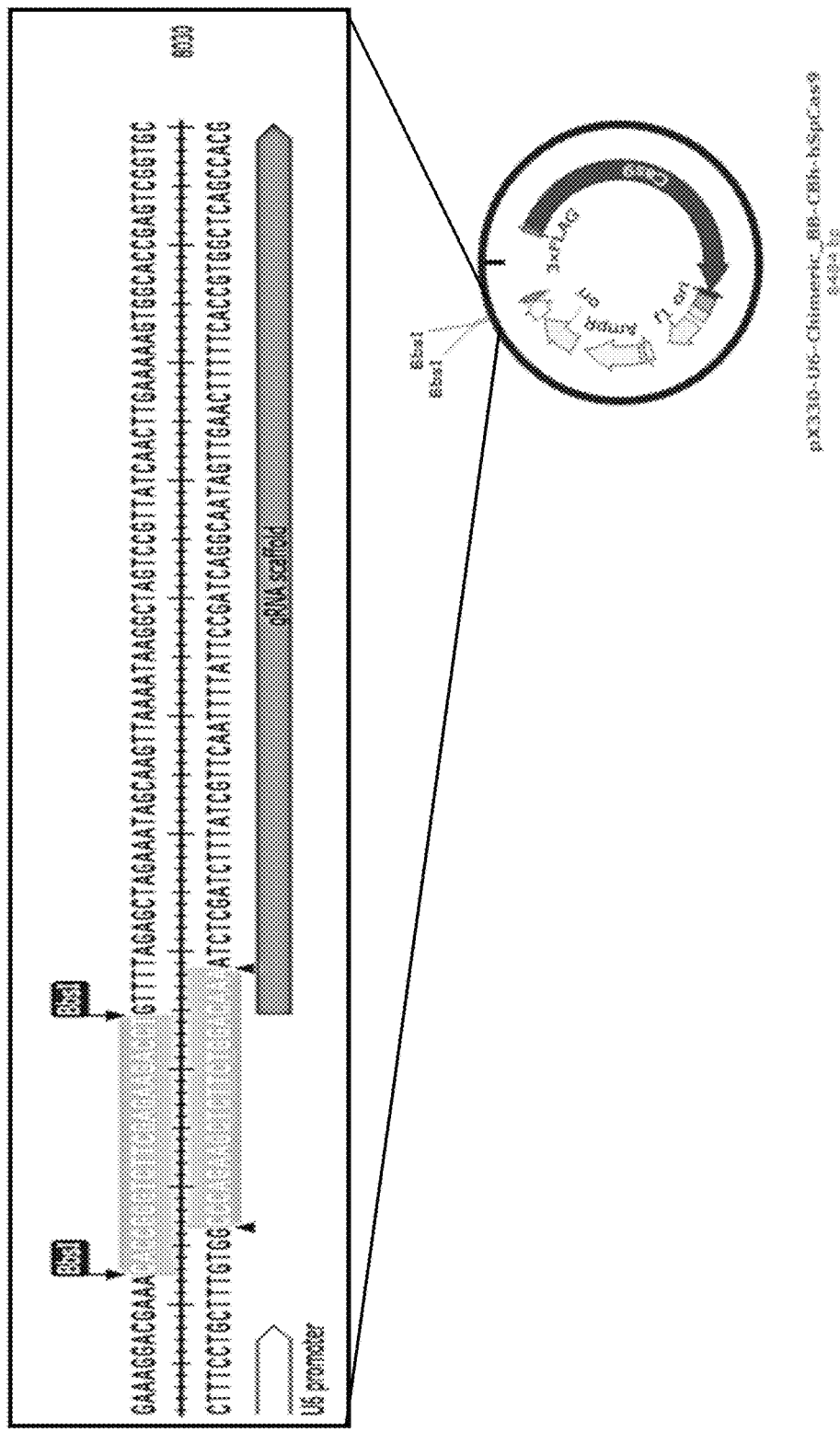
Figure 13C:
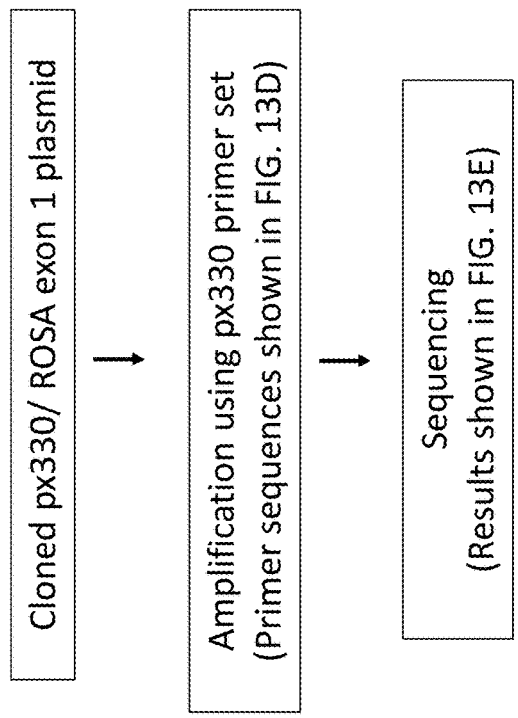
Figure 13E:
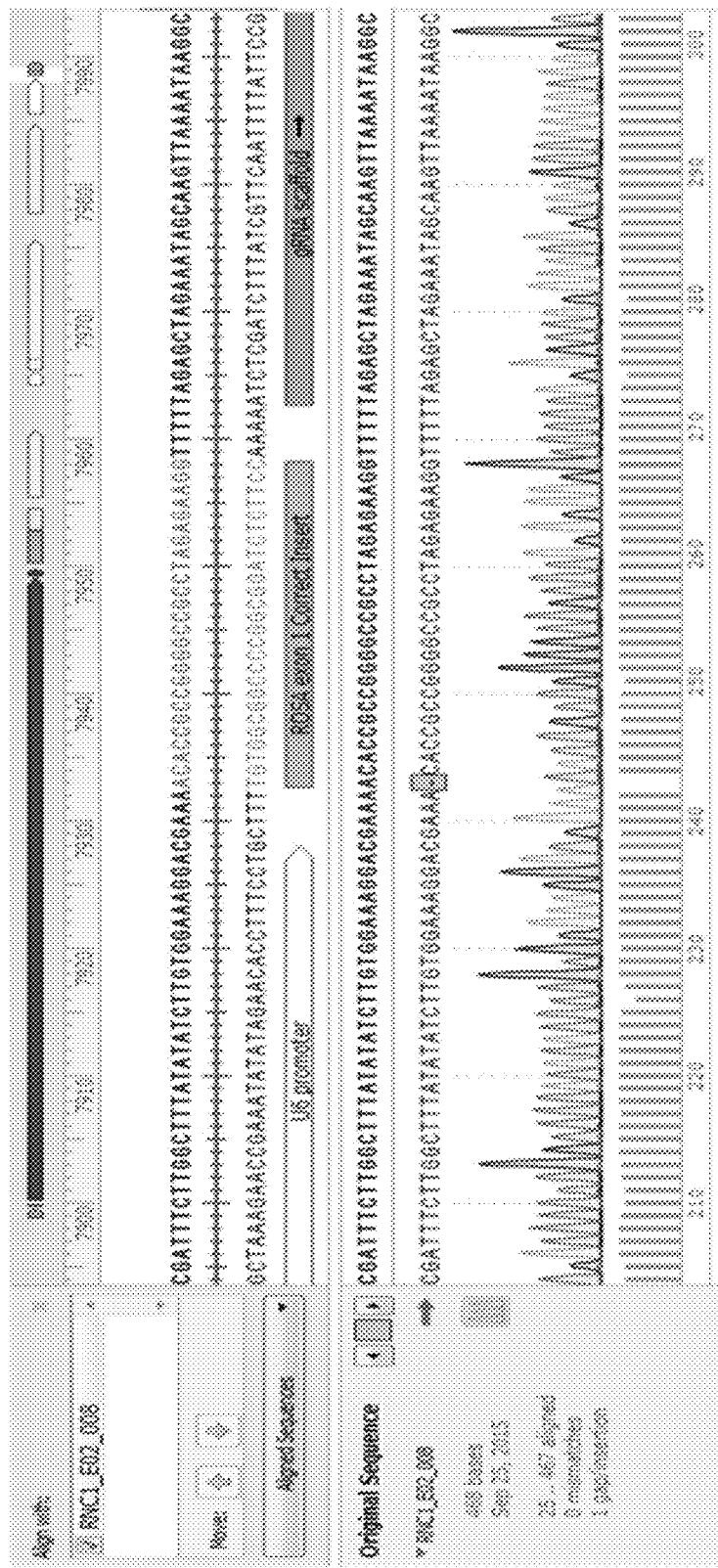

Sequencing Analysis: SnapGene software was used to align the DNA sequences. After DNA sequence results were received from the University of Minnesota Biogenomics Center, they were uploaded into the SnapGene software and aligned by the software for analysis. Base pair substitutions, deletions, and insertions were determined by referencing to the chromatograms and confirmed by comparing sequences of DNA fragments amplified using different primers. When all of the edits and confirmations were done, the resulting new DNA parent sequence was made by replacing the original parent DNA sequence with the aligned one (SEQ ID No. 188, map shown in FIG. 12). The Rosa26 sequence was different from the reference Rosa26 sequence. For example, there were base pair substitution, at positions 223, 420, 3927, 4029, and 4066, and base pair deletion between positions 2692 and 2693. Nucleotide substitutions and deletions make this sequence unique (FIG. 12). Thus the sequencing data provided more accurate sequence information for designing guide RNA targeting the Rosa26 locus.

Generating the Plasmid Expressing Guide RNA Targeting Rosa26

Oligonucleotides targeting Rosa26 was designed and synthesized by IDT. The sequences of the guide RNA are shown in Table 9. The px330 plasmid expressing guide RNA targeting Rosa26 was generated using methods described in Example 1. FIGS. 13A-13E show cloning strategies for cloning the plasmid targeting Rosa 26 (i.e., px330/ROSA exon 1) (FIGS. 13A-13E). The constructed px330 plasmid was validated by sequencing using sequencing primers shown in Table 7.

TABLE 9

Exemplary oligonucleotides for making guide RNA constructs targeting Rosa26

| Gene | SEQ ID No. | Forward sequence (5' to 3') | SEQ ID No. | Reverse sequence (5' to 3') |
|---|---|---|---|---|
| Rosa26 | 189 | acaccgccggggccgcctagagaagg | 190 | aaaaccttctctaggcggccccggcg |

Example 3

Inserting HLA-G1 Transgene at Rosa26 Locus in Porcine Cells

A transgene-will be inserted into the Rosa26 locus in pigs so that the pigs will express the transgene in all cells. This example shows exemplary methods for inserting HLA-G1 cDNA into the Rosa26 locus in pig cells (e.g., porcine fetal fibroblasts). The resulting cells will be used to generate pigs expressing HLA-G1 controlled by the Rosa26 promoter, which will direct ubiquitous expression of HLA-G1 in the pigs.

The HLA-G1 gene constructs with 1000 bp homology arms specific to the GGTA1 or Rosa26 will be created and verified by PCR and sequencing. The cDNA sequence of HLA-G1 is shown in Table 2, and the genomic sequence of HLA-G is shown as SEQ ID: No. 191. The maps of the genomic sequence and cDNA of HLA-G are shown in FIGS. 14A-14B. The flanking regions of the GGTA1 and Rosa26 in the cells will be sequenced. The expression of HLA-G1 by the construct will be validated. After sequencing and expression validation, the gene-targeting constructs will be assembled with the transgene to create a homologous domain repair template that will be used to modify somatic pig cells. The CRISPR/Cas technology will be used to target the GGTA1 or Rosa26 with plasmid-expressed guide RNA oligos, enabling efficient gene targeting and modification. Double strand DNA breaks created by guide RNA will be created in the presence of HLA-G1 gene construct with 1000 bp homology arms inducing DNA repair that incorporates the transgene. Insertion sites within 50 bp of the promoter sequence through determined open reading frames (excluding intronic regions) will be tested based on the presence of PAM sequences and promoter strength to drive transgene expression in the presence of additional Cas9 expressing plasmids. The transgenic and knockout phenotype will be evaluated by flow cytometry (e.g., detection of the transgenes expression in the cytosol and membrane surface), Western blotting, and DNA/RNA sequencing.

Example 4

Generating Plasmids that Simultaneously Express Two Guide RNAs

An alternative vector (e.g., px333) simultaneously expressing two guide RNAs will also be used for expressing guide RNA targeting two regions of a single gene. Targeting two regions of a single gene by CRISPR/cas9 system will result in removal of the entire gene between the two cut sites when the DNA is repaired back together. Targeting two regions will increase the chance of producing a biallelic knockout, resulting in better sorts, more biallelic deletions, and overall a higher chance to produce pigs with a negative genotype, comparing to only targeting one locus in the gene.

The oligonucleotide pairs used in the px333 plasmid construction will contain higher G content, lower A content, and as many GGGG quadraplexes as possible, compared with the oligonucleotides used for the px330 plasmid. The GGTA1 targets will span nearly the entire GGTA1 gene, which will remove the entire gene from the genome. Furthermore, targeting multiple sites with this strategy will be used when inserting transgenes, which is another goal of ours further along in the project.

Example 5

Isolating, Culturing and Transfecting Porcine Fetal Fibroblasts for Making Genetically Modified Pigs To generate genetically modified pigs using a px330 plasmid expressing guide RNA targeting a gene, the px330 plasmid was transfected into porcine fetal fibroblasts. The transfected fibroblasts will express the guide RNA that causes disruption of one or more target genes. The resulting fibroblasts were used for making genetically modified pigs, e.g., by somatic cell nuclear transfer. This example shows isolation and culturing porcine fetal fibroblasts, and transfection of the fibroblasts with a px330 plasmid.

Cell Culture

Fetal fibroblasts cell lines used in the generation of genetically modified pigs included: Karoline Fetal (derived from female porcine ponor P1101, which provided a high islet yield after islet isolation), Marie Louise Fetal (derived from female porcine donor P1102, which provided a high islet yield after islet isolation), Slaughterhouse pig #41 (Male; showed a high number of islets in the native pancreas (as assessed by a very high dithizone (DTZ) score)), Slaughterhouse pig #53 (showed a high number of islets in the native pancreas as assessed by a high dithizone (DTZ) score).

Muscle and skin tissue samples taken from each of these pigs were dissected and cultured to grow out the fibroblast cells. The cells were then harvested and used for somatic cell nuclear transfer (SCNT) to produce clones. Multiple fetuses (up to 8) were harvested on day 30. Fetuses were separately dissected and plated on 150 mm dishes to grow out the fetal fibroblast cells. Throughout culture, fetus cell lines were kept separate and labeled with the fetus number on each tube or culture vessel. When confluent, cells were harvested and frozen back at about 1 million cells/mL in FBS with 10% DMSO for liquid nitrogen cryo-storage.

Culture medium preparation: 5 mL Glutamax, 5 mL pen/strep, and 25 mL HI-FBS (for standard 5% FBS medium; use 10% FBS for sorted cells) were added to a 500 mL bottle of DMEM, high glucose, no glutamine, no phenol red. Centrifuge settings for spinning down all fetal fibroblasts were 5 minutes at 0.4 rcf (1600 rpm) at 4° C. Cells were thawed from liquid nitrogen storage by warming quickly to 37° C. in water bath. The thawed cells were quickly transferred to about 25 mL fresh, pre-warmed culture medium (enough to dilute the DMSO sufficiently). The cells were then spun down, the supernatant was removed and the cells were re-suspended in 1-5 mL fresh culture medium for counting or plating. Cells received a medium change every 3-4 days with pre-warmed medium, and were passaged when 90-100% confluent using TrypLE Express Dissociation Reagent.

Harvesting Adherent Fibroblasts: The medium was aspirated off the cells. DPBS was added to wash the cells. Pre-warmed (37° C.) TrypLE Express reagent was added to the cells. Minimum amount of the reagent was used to cover the cell layer thinly. The cells were incubated at 37° C. for 10 minutes. A volume of culture medium containing FBS was added to the TrypLE cell suspension to neutralize the enzyme. The cell suspension was pipetted up and down to dislodge all cells from the culture surface. The cell suspension was transferred to a 15 or 50 mL conical tube on ice. The plate/flask was checked under a microscope to ensure all cells were collected. Sometimes a medium wash helped collect cells that were left behind. The cells were spun down, and then re-suspended with fresh culture medium (between depending on size of experiment and desired cell number and density. About 80% confluence was achieved on day of transfection.

On the day of the experiment, Neon module and pipette stand was set up in a biohood. A Neon tube was placed in the pipette stand and 3 mL of Buffer E (Neon Kit) was added to the Neon tube. The module was turned on and adjusted to desired settings (for fetal porcine fibroblasts: 1300 V, 30 ms, 1 pulse). Cells were harvested using TrypLE and counted to determine the experimental setup. Needed amount of cells were transferred to a new tube and remaining cells were re-plated. Cells were spun down after counting, and re-suspended in PBS to wash. The cells were spun down and re-suspended in Buffer R (Neon Kit) according to Table 10 for the number of cells and tip sizes.

TABLE 10

Exemplary Neon ® plate formats, volumes, and recommended kits

| Format | Cell Type | DNA (μg) | siRNA (nM) | Neon ®Tip | Vol. plating medium | Cell no. | Buffer R or Buffer T |
|---|---|---|---|---|---|---|---|
| 96-well | Adherent | 0.25-0.5 | 10-200 | 10 μL | 100 μL | $1\text{-}2 \times 10^4$ | 10 μL/well |
|  | Suspension | 0.5-1 |  | 10 μL |  | $2\text{-}5 \times 10^4$ | 10 μL/well |
| 48-well | Adherent | 0.25-1 | 10-200 | 10 μL | 250 μL | $2.5\text{-}5 \times 10^4$ | 10 μL/well |
|  | Suspension | 0.5-2 |  | 10 μL |  | $5\text{-}12.5 \times 10^4$ | 10 μL/well |
| 24-well | Adherent | 0.5-2 | 10-200 | 10 μL | 500 μL | $0.5\text{-}1 \times 10^5$ | 10 μL/well |
|  | Suspension | 0.5-3 |  | 10 μL |  | $1\text{-}2.5 \times 10^5$ | 10 μL/well |
| 12-well | Adherent | 0.5-3 | 10-200 | 10 μL | 1 mL | $1\text{-}2 \times 10^5$ | 10 μL/well |
|  | Suspension | 0.5-3 |  | 10 μL |  | $2\text{-}5 \times 10^5$ | 10 μL/well |
| 6-well | Adherent | 0.5-3 (10 μL) 5-30 (100 μL) | 10-200 | 10 μL/ 100 μL | 2 mL | $2\text{-}4 \times 10^5$ | 10 μL or 100 μL/well |
|  | Suspension | 0.5-3 (10 μL) 5-30 (100 μL) |  | 10 μL/ 100 μL |  | $0.4\text{-}1 \times 10^6$ | 10 μL or 100 μL/well |
| 60 mm | Adherent | 5-30 | 10-200 | 100 μL | 5 mL | $0.5\text{-}1 \times 10^6$ | 100 μL/well |
|  | Suspension | 5-30 |  | 100 μL |  | $1\text{-}2.5 \times 10^6$ | 100 μL/well |
| 10 cm | Adherent | 5-30 | 10-200 | 100 μL | 10 mL | $1\text{-}2 \times 10^6$ | 100 μL/well |
|  | Suspension | 5-30 |  | 100 μL |  | $2\text{-}5 \times 10^6$ | 100 μL/well |

1-5 mL for counting). If counting, a 1:5 dilution of the cells suspension was prepared by adding 20 μL cell suspension to 80 μL 0.2% Trypan Blue. The suspension was mixed well by pipetting up and down. 12-14 μL of the dilution was added to a hemocytometer to count the 4 corners. The numbers were averaged. For example, counting 20, 24, 22, 22 for each corner yielded an average of 22. This number was multiplied by the dilution factor 5, yielding $110 \times 10^4$ cells/mL. The number was adjusted to $10^6$ by moving the decimal two places to the left, $1.10 \times 10^6$ cells/mL. Finally, the numbers were multiplied by how many mL's the original sample was taken from to get the total number of cells.

Transfection of Fetal Fibroblasts

This experiment was to transfect fetal fibroblasts. The transfected fetal fibroblasts were used to generate genetically modified animal using the somatic cell nuclear transfer technique.

The GFP plasmid used (pSpCas9(BB)-2A-GFP) for transfection was an exact copy of the px330 plasmid, except that it contained a GFP expression region.

GFP transfected control cells: Transfections were done using the Neon Transfection System from Invitrogen. Kits came in 10 μL and 100 μL tip sizes. A day or two before the experiment, cells were plated in appropriate culture vessel Appropriate amount of DNA according to Table 10 was added to cell suspension and mixed by pipetting up and down. A Neon tip was applied from the kit to the Neon pipette to aspirate the volume of cell suspension into the Neon tip. The pipette was placed into the Neon tube in the pipette stand so that the Neon tip was submerged in the Buffer E. START was pressed on module interface until a "complete" message appeared. The pipette was removed from the pipette stand to eject the cell suspension into a volume of pre-warmed culture medium without antibiotics in a well of appropriate size according to Table 10.

Figure 15:
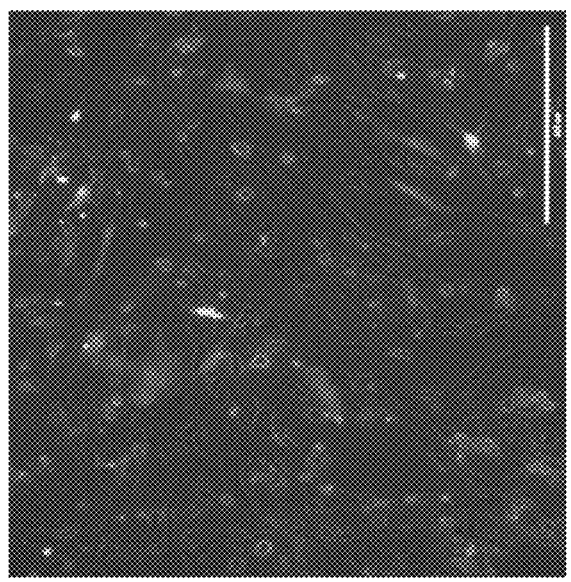
FIG. 15 shows an exemplary microscopic view of porcine fetal fibroblasts transfected with pSpCas9(BB)-2A-GFP.

The above steps were repeated until the entire cell suspension was used. Neon tips were changed every 2 transfections, and Neon tubes were changed every 10 transfections. The cells were incubated at 37° C. for 24 hours, and then the medium was changed with normal culture medium containing antibiotics. The resulting cells were cultured for about 5 days to allow for Cas9 cleavage, complete recycling of surface proteins after gene knockout, and proper cell division before sorting. The cells transfected with the GFP plasmid were shown in FIG. 15.

Example 6

Verifying Guide RNA Production by Px330 Plasmids Using RNA Polymerase

After a px330 plasmid is transfected to porcine fetal fibroblasts, the expression of guide RNA by the px330 plasmid will be verified using an RNA polymerase.

The guide RNA production by px330 plasmids will be verified by in vitro transcription of the correctly constructed plasmids by an RNA polymerase. The experiment will use the T7 RNA polymerase with a promoter introduced through PCR of the target region. Production of sgRNA by the T7 RNA polymerase will indicate that the plasmid is transcribed and the sgRNA is present in the cells. Gel verification of the reaction product (e.g., sgRNA) size will be used to confirm sgRNA transcription by the RNA polymerase.

Example 7

Fluorescence In Situ Hybridization (FISH) to the GGTA1 Gene

Gene disruption by CRISPR/cas9 was verified using FISH in a cell. This example shows exemplary methods for detecting GGTA1 gene using fluorescence in situ hybridization (FISH). The methods here were used to verify the presence or absence of a GGTA1 gene in a cell from an animal (e.g., an animal with GGTA1 knocked out).

Preparation of FISH Probes: GGTA1 DNA was extracted from an RP-44 pig BAC clone (RP44-324B21) using an Invitrogen PureLink kit. The DNA was labeled by nick translation reaction (Nick Translation Kit—Abbott Molecular) using Orange—552 dUTP (Enzo Life Science). Sizes of the nick translated fragments were checked by electrophoresis on a 1% TBE gel. The labeled DNA was precipitated in COT-1 DNA, salmon sperm DNA, sodium acetate and 95% ethanol, then dried and re-suspended in 50% formamide hybridization buffer.

Hybridization of FISH Probes: The probe/hybridization buffer mix and cytogenetic slides from pig fibroblasts (15AS27) were denatured. The probe was applied to the slides, and the slides were hybridized for 24 hours at 37° C. in a humidified chamber. The probe used is shown as SEQ ID No: 192.

Figure 16:
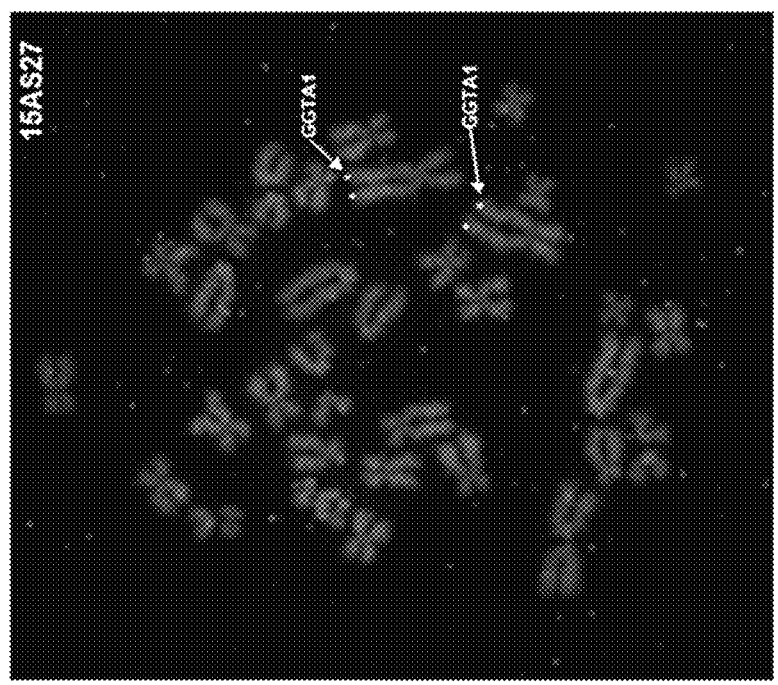
FIG. 16 shows a fluorescence in situ hybridization (FISH) to the GGTA1 gene by specific probes revealing the location on chromosome 1.

FISH Detection, Visualization and Image Capture: After hybridization, the FISH slides were washed in a 2×SSC solution at 72° C. for 15 seconds, and counterstained with DAPI stain. Fluorescent signals were visualized on an Olympus BX61 microscope workstation (Applied Spectral Imaging, Vista, Calif.) with DAPI and FITC filter sets. FISH images were captured using an interferometer-based CCD cooled camera (ASI) and FISHView ASI software. The FISH image is shown in FIG. 16.

Example 8

Phenotypic Selection of Cells with Cas9/Guide RNA-Mediated GGTA1 Knockout

Disruption of GGTA1 gene by the Cas9/guide RNA system were verified by labeling GGTA1 gene products. The GGTA1 knockout will be used as a marker for phenotypic sorting in knockout experiments. The GGTA1 gene encoded for a glycoprotein found on the surface of pig cells that if had been knocked out, would result in the glycoprotein being absent on the cell's surface. The lectin used to sort for GGTA1 negative cells was Isolectin GS-IB$_4$ Biotin-XX conjugate, which selectively bound terminal alpha-D-galactosyl residues, such as the glycoprotein produced by the GGTA1 gene.

Porcine fetal fibroblast cells were transfected with px330 plasmid expressing guide RNA targeting GGTA1 (generated in Example 1).

To select for negative cell after transfection, the cells were allowed to grow for about 5 days to recycle their surface proteins. The cells were then harvested, and labeled with the IB$_4$ lectin. The cells were then coated with DynaBeads Biotin-Binder, which were 2.8 micron supermagnetic beads that had a streptavidin tail that bound very tightly with the biotin-conjugated lectin on the surface of the cells. When placed in a magnet, the "positive" cells with lectin/beads bound on the surface stick to the sides of the tube, while the "negative" cells did not bind an beads and remained floating in suspension for an easy separation.

In detail, the cells were harvested from a plate using a TrypLE protocol and collected into a single tube. The cells were spun down, and re-suspended in 1 mL of sorting medium (DMEM, no supplements) to count. If less than 10 million cells, the cells were spun down and the supernatant was discarded. In a separate tube, IB$_4$ lectin (1 μg/μL) was diluted by 5 μL to 1 mL of sorting medium (final concentration 5 μg/mL). The cell pellet was re-suspended with the 1 mL of diluted lectin. The cell suspension was incubated on ice for about 15-20 minutes, with gentle sloshing every few minutes.

Biotin beads were prepared during incubation. A bottle of beads were vortexed for 30 seconds. 20 μL beads/1M cells were added to 5 mL of sorting medium in a 15 mL conical tube. The tube was vortexed, placed in DynaMag-15 magnet and let stand for 3 minutes. Medium were removed. 1 mL of fresh sorting medium was added and the tube was vortexed to wash the beads. The washed beads were placed on ice until use.

After cell incubation, cell suspension's volume was brought to 15 mL with sorting medium to dilute the lectin. The cells were spun and re-suspended with 1 mL of the washed biotin beads. The suspension was incubated on ice for 30 minutes in a shaking incubator at 125 rpm. The cell suspension was removed from shaking incubator and inspected. Small aggregates might be observed.

5 mL of sorting medium was added to the cell suspension and the tube was placed in the DynaMag-15 for 3 minutes. The first fraction of "negatives" cells was collected and transferred to a new 15 mL conical tube. Another 5 mL sorting medium was added to wash the "positive" tube that was still on the magnet. The magnet was inverted several times to mix the cell suspension again. The tube was let stand for 3 minutes to separate cells. The second "negative" fraction was then removed and combined with the first fraction. 10 mL sorting medium was added to the "positive" tube. The tube was removed from the magnet, and placed in an ice bath until ready to use.

The tube of "negative" fractions was placed onto the magnet to provide a secondary separation and remove any bead-bound cells that might have crossed over from the first tube. The tube was kept on the magnet for 3 minutes. The cells were pipetted away from the magnet and transferred into a new 15 mL conical tube. The original "positive" tube and the double sorted "negative" tube were balanced and cells in them were spun down. The pellet of the "positives" appeared a dark, rusty red. The "negative" pellet was not visible, or appeared white.

Figure 17B:
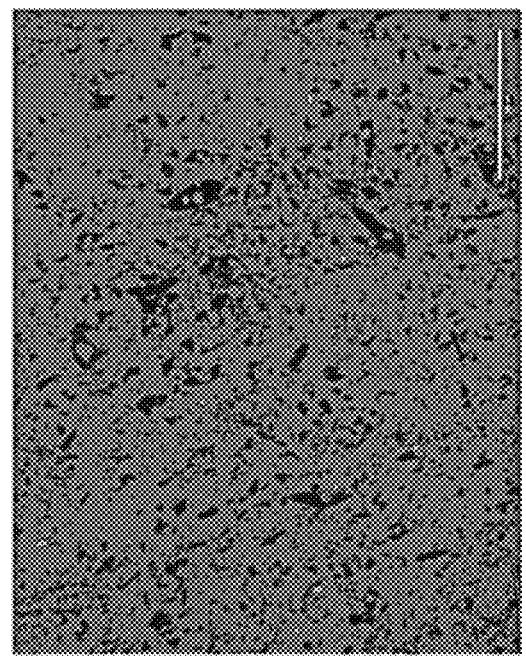
FIGS. 17A-17B demonstrate an example of phenotypic selection of cells with cas9/sgRNA-mediated GGTA1/NLCR5 disruption.
Figure 17A:
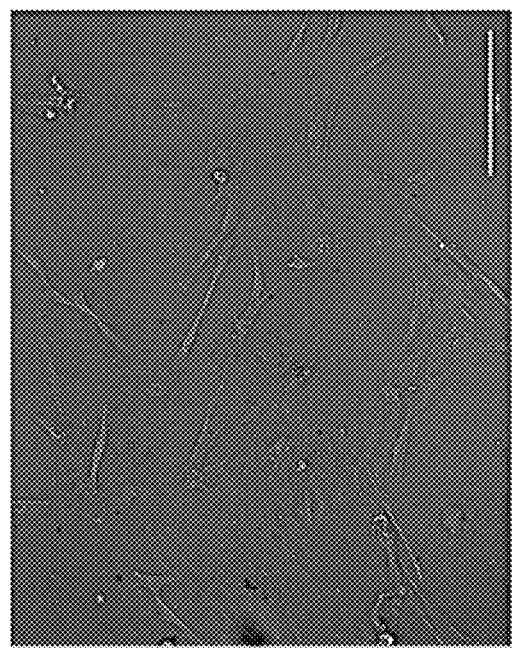

Each pellet was re-suspended in 1 mL of fresh culture medium (10% FBS) and plated into separate wells on a 24-well plate. The wells were inspected under a microscope and diluted to more wells if necessary. The cells were cultured at 37° C. The genetically modified cells, i.e., unlabeled cells were negatively selected by the magnet (FIG. 17A). The non-genetically modified cells, i.e., the labeled cells had accumulated ferrous beads on the cell surface (FIG. 17B).

Example 9

Making GGTA1/CMAH/NLRC5 Triple Knockout Pigs

This example shows exemplary methods for generating a triple knockout pigs. A triple knockout pig can have reduced protein expression of three of the following: NLRC5, TAP1, C3, CXCL10, MICA, MICB, CIITA, CMAH, GGTA1 and/or B4GALNT2. One of such triple knockout pig was GGTA1/CMAH/NLRC5 triple knockout pigs using CRISPR/cas9 system. The pigs provided islets for transplantation. Porcine islets with disrupted GGTA1/CMAH/NLRC5 had MHC class I deficiency and will induce low or no immuno-rejection when transplanted to a recipient.

Transfection of Fetal Fibroblasts

The px330 plasmids expressing guide RNA targeting GGTA1, CMAH, and NLRC5 generated in Example 1 were transected in porcine fetal fibroblasts. Pig fetal fibroblasts were cultured in DMEM containing 5-10% serum, glutamine and penicillin/streptomycin. The fibroblasts were co-transfected with two or three plasmids expressing Cas9 and sgRNA targeting the GGTA1, CMAH or NLRC5 genes using Lipofectamine 3000 system (Life Technologies, Grand Island, N.Y.) according to the manufacturer's instructions.

Counter-Selection of GGTA1 KO Cells

Four days after transfection, the transfected cells were harvested and labeled with isolectin B4 (IB4)-biotin. Cells expressing αGal were labeled with biotin conjugated IB4 and depleted by streptavidin coated Dynabeads (Life Technologies) in a magnetic field. The αGal deficient cells were selected from the supernatant. The cells were examined by microscopy. The cells containing no or very few bound beads after sorting were identified as negative cells.

DNA Sequencing Analysis of the CRISPR/Cas9 Targeted GGTA1, CMAH and NLRC5 Genes

Figure 18A:
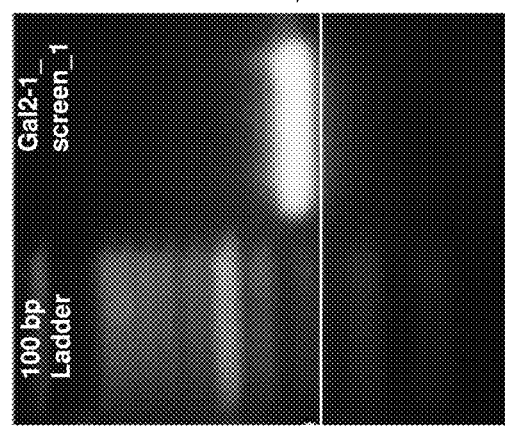
Figure 18B:
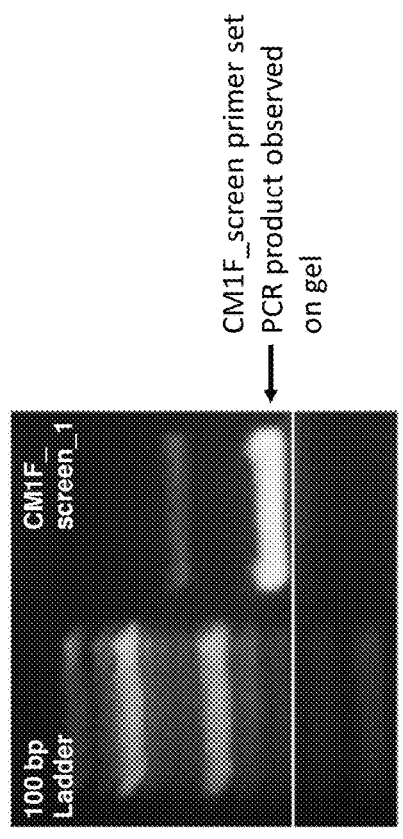

Genomic DNA from the IB4 counter-selected cells and cloned pig fetuses were extracted using Qiagen DNeasy Miniprep Kit. PCR was performed with GGTA1, CMAH and NLRC5 specific primer pairs as shown in Table 11. DNA polymerase, dNTPack (New England Biolabs) was used and PCR conditions for GGTA1 were based on annealing and melting temperature ideal for those primers. The PCR products were separated on 1% agarose gel, purified by Qiagen Gel Extraction Kit and sequenced by the Sanger method (DNA Sequencing Core Facility, University of Minnesota) with the specific sequencing primers as shown in Table 7. FIGS. 18A-18C show the sequences and agarose gel images of the PCR products.

TABLE 11

Exemplary PCR primers for amplifying genomic DNA from genetically modified cells and animals

| Gene | SEQ ID No. | Forward sequence (5' to 3') | SEQ ID No. | Reverse sequence (5' to 3') |
|---|---|---|---|---|
| GGTA1 | 193 | cttcgtgaaaccgctgtttatt | 194 | gactggaggactttgtcttctt |
| CMAH | 195 | tgagttccttacgtggaatgtg | 196 | tcttcaggagatctgggttct |
| NLRC5 | 197 | ctgctctgcaaacactcaga | 198 | tcagcagcagtacctcca |

Somatic Cell Nuclear Transfer (SCNT)

SCNT was performed as described by Whitworth et al. *Biology of Reproduction* 91(3):78, 1-13, (2014), which is incorporated herein by reference in its entirety. The SCNT was performed using in vitro matured oocytes (DeSoto Biosciences Inc., St. Seymour, Tenn.). Cumulus cells were removed from the oocytes by pipetting in 0.1% hyaluronidase. Only oocytes with normal morphology and a visible polar body were selected for SCNT. Oocytes were incubated in manipulation media (Ca-free NCSU-23 with 5% FBS) containing 5 μg/mL bisbenzimide and 7.5 μg/mL cytochalasin B for 15 min. Oocytes were enucleated by removing the first polar body plus metaphase II plate. A single cell was injected into each enucleated oocyte, fused, and activated simultaneously by two DC pulses of 180 V for 50 μsec (BTX cell electroporator, Harvard Apparatus, Hollison, Mass., USA) in 280 mM Mannitol, 0.1 mM $CaCl_2$, and 0.05 mM $MgCl_2$. Activated embryos were placed back in NCSU-23 medium with 0.4% bovine serum albumin (BSA) and cultured at 38.5° C., 5% $CO_2$ in a humidified atmosphere for less than 1 hour, and transferred into the surrogate pigs.

Example 10

Making NLRC5 Knockout Non-Human Animals Expressing an ICP47 Transgene

This example shows exemplary methods for generating genetically modified non-human animals (e.g., pigs) with reduced expression of one or more endogenous genes and meanwhile expressing one or more transgenes. Such generating genetically modified non-human animals (e.g., pigs) will have reduced expression of one or more of NLRC5, TAP1, C3, CXCL10, MICA, MICB, CIITA, CMAH, GGTA1 and/or B4GALNT2, and meanwhile expressing one or more ICP47, CD46, CD55, CD59 HLA-E, HLA-G (e.g., HLA-G1, HLA-G2, HLA-G3, HLA-G4, HLA-G5, HLA-G6, or HLA-G7), L2, Spi9, galectin-9 CD47, B2M, PD-L1, and/or PD-L2. One of such animal will have disrupted NLRC5 gene and meanwhile overexpressing a transgene encoding ICP47. NLRC5 disruption and ICP47 expression will suppress MHC-1 assembly and function. Thus, cells, tissues, and/or organs from the genetically modified non-human animals (e.g., pigs) will induce low or no immuno-rejection when transplanted to a recipient.

Cloning Rosa26 Promoter

The Rosa26 promoter sequence will be obtained by searching genome databases (NCBI) using mouse Rosa26 promoter sequence and human Rosa26 promoter sequence as references. The non-human animal's version of the Rosa26 will be obtained. Primers will be designed to amplify a DNA fragment harboring potential Rosa26 promoter (e.g., porcine Rosa26 promoter) by PCR using the non-human animal's (e.g., a domestic pig's) genomic DNA as a template. AscI and MluI sites will be added to the 5' of forward and reverse primers, respectively. Pwo SuperYield DNA Polymerase (Roche, Indianapolis, Ind.) will be used and PCR conditions will be as follows: 94° C., 2 minutes; 94° C., 15 seconds, 55° C., 30 seconds; 72° C. 4 minutes for 15 cycles; 94° C., 15 seconds, 55° C., 30 seconds; 72° C. 4 minutes and 5 seconds added to each cycle for 25 cycles; and a final extension step of 72° C. for 8 minutes. The PCR product will be subsequently cloned into pCR-XL-TOPO vector (Invitrogen, Carlsbad, Calif.) to generate pCR-XL-Rosa26. The non-human animal's Rosa promoter (e.g., porcine Rosa26 promoter) will be sequenced using designed primers.

Construction of Transgenic Vector

CMV promoter and multiple cloning site (MCS) of pEGFP-N1 (Clontech, Palo Alto, Calif.) will be replaced by a linker AseI-NruI-AscI-SalI-MluI-PvuI-BamHI. A 3.9 kb fragment containing the potential non-human animal's (e.g., porcine) Rosa26 promoter will be excised from pCR-XL-Rosa26 with AscI and MluI digestion and inserted to the promoterless pEGFP-N1 between AscI and Mlu I sites, resulting in plasmid pRosa26-EGFP. Human ICP47 cDNA will be cloned to replace EGFP in the plasmid. The control vector will be constructed by cloning of ICP47 cDNA to the downstream of murine MHC class I H-$2K^b$ promoter at EcoRI site, resulting in plasmid pH-$2K^b$-ICP47.

Transient Transfection

NLRC5 KO fetal fibroblast cells from the NLRC5 knockout non-human animals (e.g., pigs) made by the methods of Example 1 or Example 2 will be obtained. To compare promoter strength among Rosa26, H-$2K^b$, and CMV, fetal fibroblast cells will be transfected with pRosa26-ICP47, pH-$2K^b$-ICP47 and pEGFP-N1 by using Neon™ Transfection System (Invitrogen, Carlsbad, Calif.) as per the manufacturer instructions. $3 \times 10^5$ cells will be mixed with 1.5 µg of each DNA, respectively, and electroporated at 1300V, 30 ms, 1 pulse. Then cells will be cultured at 37° C. with 5% $CO_2$ and 10% $O_2$. After 48 hours, cells will be harvested and ICP47 expression will be examined by Western blot and/or flow cytometry. Untransfected fetal fibroblasts will be used as a control.

Establishment of EGFP Stable Cell Line

NLRC5 KO fetal fibroblasts at 80-90% confluence will be harvested with trypsin and washed with calcium and magnesium free DPBS (Invitrogen, Carlsbad, Calif.). pRosa26-ICP47 will be linearized by Asc I digestion. Transfection will be performed by using Neon™ Transfection System (Invitrogen). Briefly, $10^6$ cells will be suspended in 120 µl of R buffer and 2 µg of linearized DNA will be added. Cells will be electroporated at 1300V, 30 ms, 1 pulse, and plated onto collagen I coated plates (BD) in the culture media without antibiotics. After 48 hours, the culture media will be replaced with selection media containing 100 µg/ml of G418 (Invitrogen). After 10 days of G418 selection the ICP47 positive cells will be isolated by flow sorting. The selected cells will be expanded and the second flow sorting will be performed to purify and enrich the ICP47 positive cells.

Somatic Cell Nuclear Transfer

SCNT will be performed using in vitro matured oocytes (DeSoto Biosciences Inc. St Seymour, Tenn. and Minitub of America, Mount Horeb, Wis.). Cumulus cells will be removed from the oocytes by pipetting in 0.1% hyaluronidase. Only oocytes with normal morphology and a visible polar body will be selected for cloning. Oocytes will be incubated in manipulation media (Ca-free NCSU-23 with 5% FBS) containing 5 mg/mL bisbenzimide and 7.5 mg/mL cytochalasin B for 15 min. Following this incubation period, oocytes will be enucleated by removing the first polar body and metaphase II plate, and one single cell will be injected into each enucleated oocyte. Electrical fusion will be induced with a BTX cell electroporator (Harvard Apparatus, Holliston, Mass.). Couples will be exposed to two DC pulses of 140 V for 50 ms in 280 mM Mannitol, 0.001 mM $CaCl_2$, and 0.05 mM $MgCl_2$. One hour later, reconstructed oocytes will be activated by two DC pulses of 120 V for 60 ms in 280 mM Mannitol, 0.1 mM $CaCl_2$, and 0.05 mM $MgCl_2$. After activation, oocytes will be placed back in NCSU-23 medium with 0.4% bovine serum albumin BSA and cultured at 38.5° C., 5% $CO_2$ in a humidified atmosphere, for less than 1 h before being transferred into the recipient. Recipients will be synchronized non-human animals (e.g., occidental pigs) on their first day of estrus.

Genotyping of ICP47 Transgenic Fetuses

The pregnancy will be terminated at day 35 and fetuses will be harvested. Genomic DNA will be extracted using DNeasy Blood & Tissue Kit (Qiagen). PCR primers will be designed to detect ICP47 cDNA sequence in the genome. The 20 µl of reaction mixture contained 10 µl of 2×Go-Taq Green Master Mix (Promega, Madison, Wis.), 5 pmol of each primer, and 50 ng of genomic DNA. PCR will be performed to detect the presence or absence of ICP47 insert. Genomic DNA extracted from normal cells will be used as negative control.

Example 11

Making NLRC5 Knockout Non-Human Animals by Injecting RNA Encoding Cas9 and Guide RNA An alternative approach to targeting a gene using CRISPR/cas will be to directly inject an RNA molecule encoding Cas9 and a guide RNA (e.g., single guide RNA (sgRNA)) into a cell to disrupt a gene by CRISPR/cas9 system. This example shows exemplary methods for disrupting NLRC5 in non-human animals (e.g., pigs) by injection of RNA encoding Cas9 and a single guide RNA (sgRNA).

The sgRNA targeting the NLRC gene will be designed and synthesized. To construct the Cas9 encoding plasmid, the Cas9 coding sequence will be synthesized and then cloned into the pEASY-T1 vector, which harbors a T7 promoter for the in vitro transcription of Cas9. A SV40 polyadenylation signal will be at the 3' end of the Cas9 cassette, and a unique HindIII restriction site will be outside of SV40 signal for linearization. The T7 promoter containing sgRNA scaffold will also be ordered and cloned into a promoterless pUC19 vector. Two BsaI restriction sites will be used for the spacer insertion and the plasmid will be linearized by PsiI for in vitro transcription. For targeting vector construction, a site-specific 20 nt spacer will be synthesis and cloned into T7-sgRNA scaffold between BsaI restriction sites.

To prepare Cas9 mRNA, T7-Cas9 expression plasmid will be linearized by HindIII, and purified using DNA Clean & Concentrator™-5 (ZYMO Research).

To prepare sgRNA, the sgRNA vector will be linearized using PsiI and purified by using DNA Clean & Concentrator™-5 (ZYMO Research).

All the linearized plasmid will be in vitro transcribed by T7 High Yield RNA Synthesis Kit (NEB) following the manufacturer's instruction. To synthesize Cas9 mRNA, the m7G(5')G RNA Cap Structure Analog (NEB) will be additionally added to stabilized the transcribed mRNA. Prepared RNA will be purified using MicroElute RNA Clean-Up Kit (Omega) and recovered in DEPC water.

The zygotes from the non-human animal, e.g., Bama minipig, will be collected on the next of insemination, transferred to manipulation medium and subjected to a single cytoplasmic microinjection of 2-10 pl of 125 ng/µl Cas9 mRNA and 12.5 ng/µl sgRNA. Alternatively, fertilized oocytes of the non-human animal will be collected. The Cas9 and sgRNA will be injected into the fertilized oocytes to generate genetically modified offspring. To test the viability of non-human animal (e.g., pigs) embryos after RNA injection, in vitro produced parthenogenetic embryos will be used for preliminary experiment. For parthenogenetic embryos preparation, non-human animal (e.g., pig) ovaries will be collected, washed with pre-warmed saline and follicles aspirated. Oocytes will be washed in TL-HEPES before culturing in maturation medium for 44 hours. Matured MII oocytes will be depleted off surrounding cumulus cells by gentle pipetting, followed by electrical activation by two direct current pulses (1-sec interval) of 1.2 kV/cm for 30 microseconds. Activated oocytes will be transferred to TL-HEPES medium and subjected to a single 2-10 pl cytoplasmic injection of 125 ng/µl Cas9 mRNA and 12.5 ng/µl sgRNA. Zygotes and activated oocytes will be cultured to blastocyst stage in PZM3 medium for 144 hours under 5% CO2, 39° C.

Cas9 mRNA and the guide RNA will be co-injected to non-human animal zygotes (e.g., pig zygotes). The in vitro developmental efficiencies of zygotes injected with Cas9 mRNA/guide RNA and zygotes injected with water will be measured to determine effect of microinjection manipulation the Cas9 mRNA/guide RNA on non-human animal (e.g., pig) early embryonic development.

The injected embryos will be transferred into surrogate non-human animals (e.g., pigs) to produce offspring (e.g., piglets). The survived embryos will be transferred into the oviduct of recipient gilts on the day or 1 day after estrus, following mid-line laparotomy under general anesthesia. Pregnancy will be diagnosed about after 28 days, and then checked regularly at 2-week intervals by ultrasound examination. All of the microinjected offspring (e.g., piglets) will be delivered by natural birth.

A total of 76 injected embryos will be transplanted into 5 surrogate mothers in 5 independent experiments. Insertions or deletions in the targeting sites of the NLRC5 gene will be detected by T7 endonuclease I (T7EI) assay. Genotypes of the offspring (e.g., piglets) will be analyzed by Sanger sequencing of the PCR products containing the targeting site of each individual offspring (e.g., piglets).

Example 12

Identifying Immune Cells that Respond to Porcine Islet Xenografts in Nonhuman Primates This example shows exemplary methods for identifying the targeting immune cells for immune intervention in cellular xenotransplantation. To this end, the phenotypes of circulating and graft T and B lymphocyte subsets with effector and regulatory functions were studied in cynomolgus macaques (CM) receiving immunosuppression without and with donor antigen-specific immunotherapy for the prevention of porcine islet xenograft rejection.

Cellular immunity to intraportal porcine islet xenografts was retrospectively analyzed in 4 cohorts of diabetic CM: induction with α-CD40 and maintenance with CTLA4-Ig and rapamycin (Cohort A; n=4; graft function 77 to 333 days); induction with CTLA4-Ig and maintenance with α-CD40 and rapamycin (Cohort B; n=3; stable graft function more than 180 days); induction with α-CD40, α-CD20, and rapamycin, no maintenance (Cohort C; n=2; graft function for 32 and 40 days), and induction with peritransplant infusions of apoptotic donor leukocytes under the cover of α-CD40, α-CD20, and rapamycin, no maintenance (Cohort D; n=3; graft function for 81, 100, and 113 days). The frequencies of circulating immune cell subsets and liver mononuclear cells (LMNC) at sacrifice were determined by flow cytometry. LMNC were also analyzed for effector molecules after ex-vivo stimulation with donor antigen. Statistical significance was determined using unpaired t test with or without Welch's correction.

Baseline frequencies of circulating immune cell subsets were not different between Cohorts. Compared with Cohort A CM, through day 100 post-transplant, Cohort B CM showed: i) significant increases in ratios of naïve (CD3-CD20+CD21+CD27−) vs. activated memory (CD3-CD20+CD21+CD27+) and immature (CD3-CD19+CD27-IgM+) vs. mature (CD3-CD19+CD27+CD38+) circulating B cells, ii) significant increases in circulating Bregs (CD19+CD24hiCD38hi), Tregs (CD4+CD25+FoxP3+CD127), and Natural Suppressor Cells (NSC; CD122+CD8+), and iii) comparable circulating frequencies of CD8+ effector memory (TEM) cells (CD2hiCD28-CD8+). Cohort C but not D CM showed a significant expansion of CD8+ TEM at day 14 post-transplant. Compared with Cohort C CM, at day 50±10 post-transplant, Cohort D CM showed significant increases in circulating frequencies of Tregs and NSC. By day 50, there was also a significant expansion of CD8+ TEM in Cohort D. In CM terminated because of presumed rejection, LMNC showed a substantial presence of CXCR3+ CD4+ and CD8+ T cells and CD20+ B cells (including in α-CD20 treated Cohort C and D CM); CD8+ TEM were the predominant phenotype among LMNCs. Upon ex-vivo stimulation with donor antigen, these CD8+ TEM showed abundant staining for IFN-γ, TNF-α, and Perforin.

The results provided insights into the effects of immunotherapy on cellular immunity in pig-to-CM islet xenotransplantation and identify B cells and CD8+ TEM as targets for immune intervention in cellular xenotransplantation.

Example 13

Suppressing SLA on Pig Islets Inhibited Human CD8+ T Cells Response to the Pig Islets To determine whether suppression of MHC in pig islets (e.g., SLA) can inhibit T cell activation in a human recipient, SLA antibodies were used to suppress MHC on the pig islets, and human T cells' response to the pig islets was examined.

Human peripheral blood mononuclear cells were cultured with adult pig islets for 7 days with or without an anti-SLA class I blocking antibody. Proliferation of highly purified human CD8+ T cells (hCD8), human CD4+ T cells (hCD4), and human natural killer cells (hNK) were measured. The proliferation of the highly purified human CD8+ T cells, but not CD4+ T or NK cells, was inhibited. The recognition of MHC class I molecules on pig islets was blocked by the anti-SLA class I blocking antibody after 7 days in the mixed culture (FIG. 19A).

Adult pig islets cultured with or without highly purified lymphocytes for 7 days in the present or absence of an anti-SLA class I blocking antibody. The viability of the cultured cells was assessed by acridine orange (AO) and propidium iodide (PI) staining. Cytotoxicity of purified CD8+ T cells was inhibited in the presence of the anti-SLA I antibody (FIG. 19B). In spite of significant proliferation, CD4+ T cells left islets relatively unharmed when compared to the cytotoxicity of CD8+ T cells (FIG. 19B).

Example 14

Suppressing T Cell Activation by ECDI-Fixed Splenocytes in a Monkey Transplanted with Porcine Islets To determine whether apoptotic splenocytes from a xenograft donor can suppress immuno-rejection of the xenograft by a recipient, the apoptotic splenocytes from the donor were administered to the recipient before and after transplant. Then T cell activation in the recipient's PBMCs was examined.

Figure 20B:
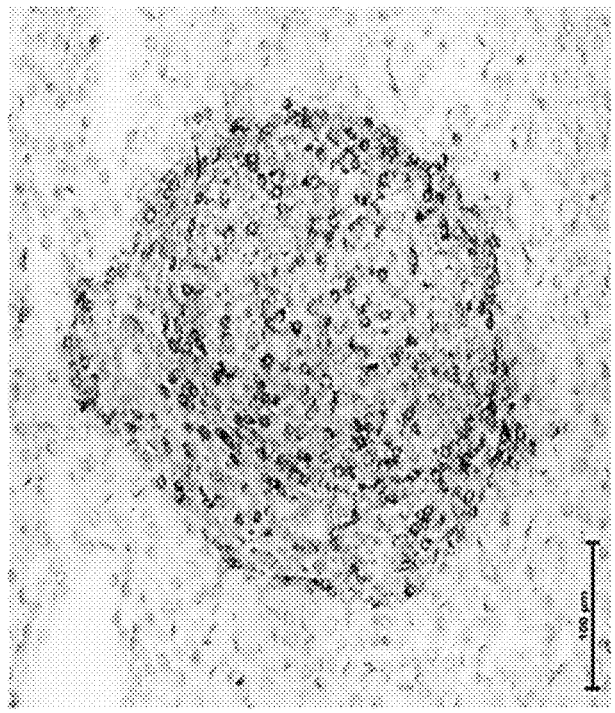
FIGS. 20A-20B demonstrate T cell activation induced by porcine islets.
Figure 20A:
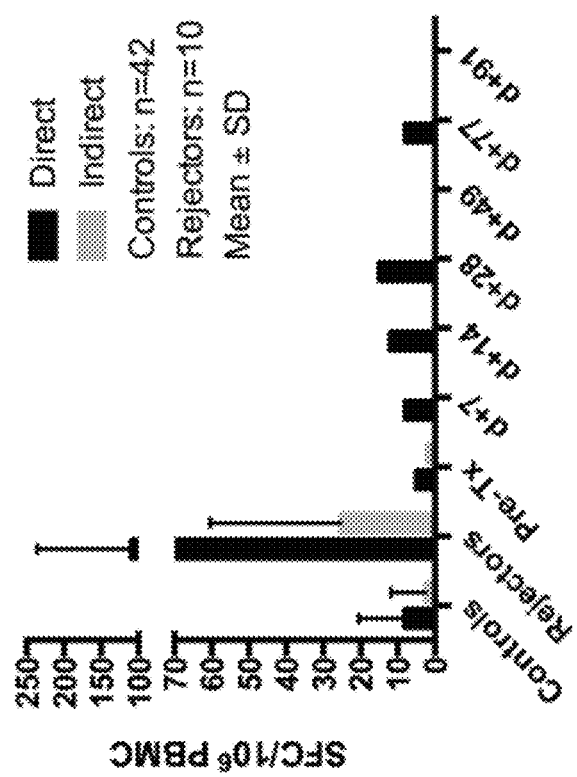

Porcine islets were transplanted to a diabetic monkey. Apoptotic splenocytes prepared from islets donor were administered to the monkey 1 day before and 7 days after transplant. PBMCs were collected from the monkey before transplantation, and 7, 14, 28, 49, 77, and 91 days after transplantation. Direct and indirect T cell activation in the PBMCs was examined by ELISPOT. The ELISPOT result was shown as spot-forming cells (SFC)/$10^6$ PBMCs (FIG. 20A). On day 141, an islet was collected from the monkey and CD8 was detected by immunohistochemistry using anti-CD8 antibody (FIG. 20B). PBMCs from 42 non-transplanted monkeys were used as a negative control ("Controls"). PBMCs from 10 monkeys transplanted with non-genetically modified porcine islets were used as a positive control ("Rejectors"). Administration of splenocytes significantly reduced T cell activation induced by the porcine islets in the monkey.

Example 15

Treating Diabetes by Transplanting Immuno-Modulated Porcine Islets and ECDI-Fixed Splenocytes from the Same Donor in Monkeys without Maintenance of Immunosuppression In addition to testing the immunosuppression effect of ECDI-fixed donor cells on immune cells in Example 14, experiments in this example examined the immunosuppression effect of ECDI-fixed donor cells in vivo (in monkeys).

The results showed that ECDI-fixed splenocytes from a pig reduced the immuno-rejection in a monkey transplanted with islets from the pig.

Figure 21B:
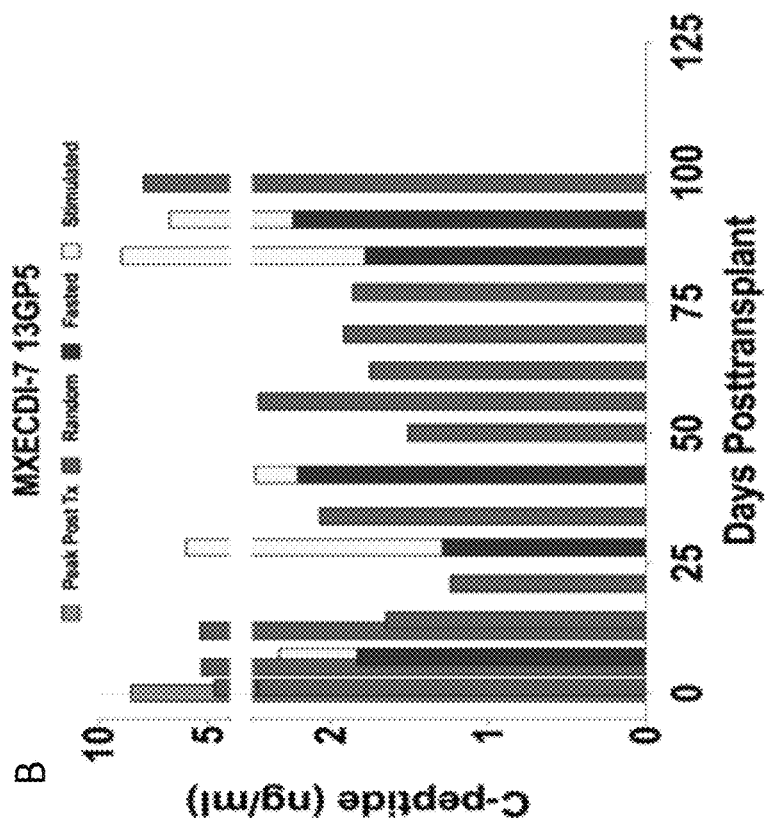
FIGS. 21A-21D demonstrate porcine islet graft survival in a monkey in the absence of maintenance immunosuppression.
Figure 21A:
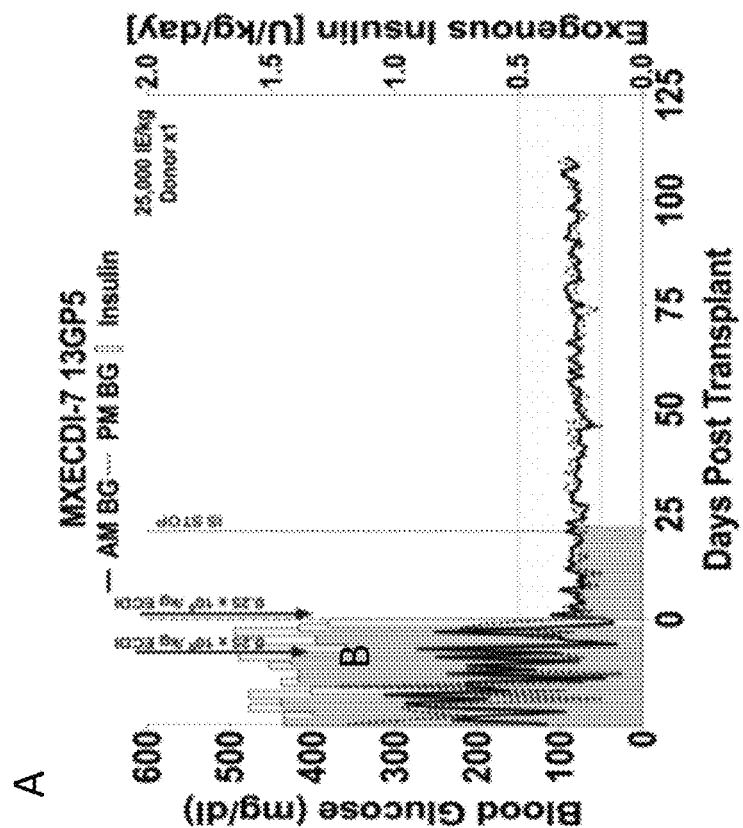

A diabetic monkey was transplanted with porcine islets. The monkey was given ECDI-fixed donor splenocytes (by intravenous infusion) 7 days before and 1 day after the transplantation. Immunosuppression drugs were given from the day of transplantation through day 21 after the transplantation. Small doses of exogenous insulin were administered through day 21 after the transplantation. The exogenous insulin (shown in gray bars) needed to maintain normal blood glucose level was reduced on the day of transplantation and completely stopped on day 21. Blood glucose level (shown in lines) became normal immediately after transplantation and continued to be normal despite discontinuation of insulin on day 21. The blood glucose level kept normal without exogenous insulin over day 100 after transplantation (FIG. 21A). The blood C-peptide levels including the peak value after transplantation, the random level, and the level under fasting and glucose-stimulation conditions were tested (FIG. 21B).

Figure 21D:
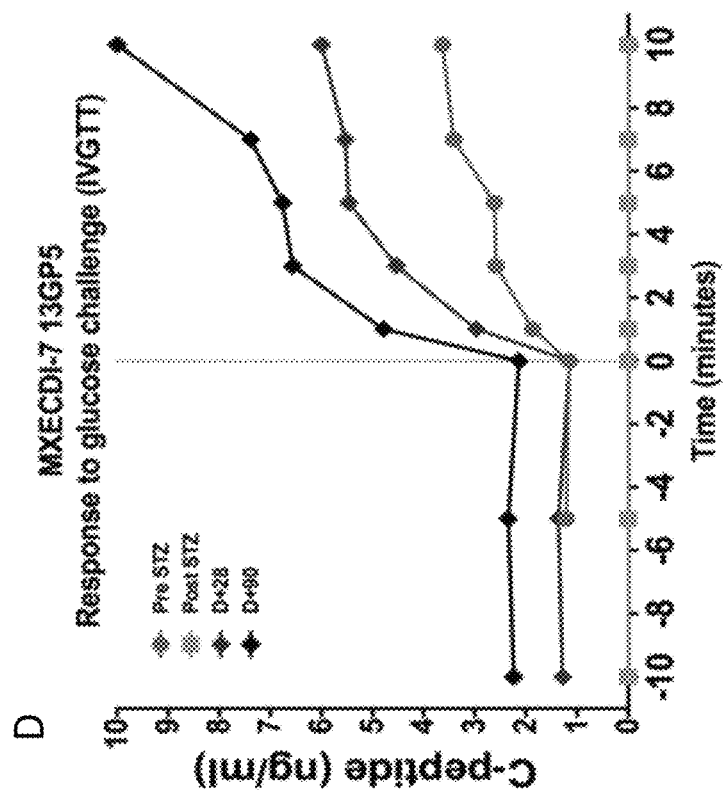
Figure 21C:
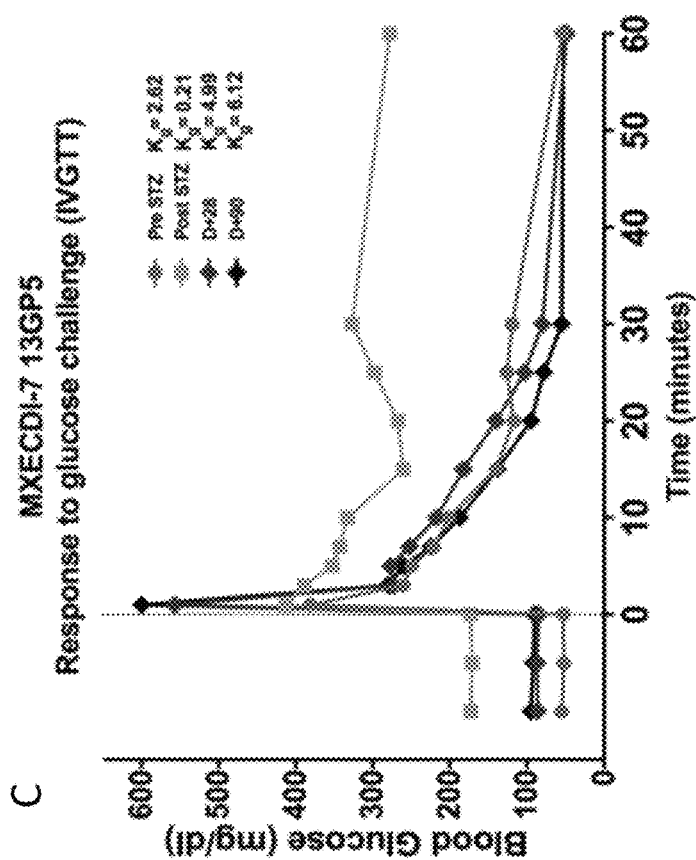

The glucose metabolism of the monkey was examined by intravenous glucose tolerance test (IVGTT) (FIGS. 21C and 21D). In IVGTT, exogenous glucose was injected to the monkey, and the blood glucose level was measured over time after the injection. IVGTT was performed on the monkey on day 28 and day 90 after transplantation. Non-transplanted monkeys treated with or without streptozotocin were used as controls. The non-transplanted monkeys treated with streptozotocin were used as a diabetic control. The blood glucose (FIG. 21C) and C-peptide (FIG. 21D) levels were measured and compared with the controls.

Example 16

Tolerizing a Recipient and Transplantation with ECDI-Fixed Cells

Cells from a transplant donor will be fixed by ECDI and used to suppress immuno-rejection in a recipient. This example shows exemplary methods for tolerizing a transplant recipient with ECDI-fixed genetically modified cells. Human recipients in need of transplantation will be treated with ECDI fixed cells to tolerize the recipient to transplantation. The ECDI fixed cells will be genetically modified, for example, GGTA1 and CMAH will be knocked out. B4GALNT2 will also be knocked in some of the ECDI fixed cells. Some or all of the ECDI fixed cells will also express one or more genes that are ICP47, CD46, CD55, or CD59.

The ECDI fixed cells will be given to the recipient about 7 days before transplantation and again at about 1 day after transplantation.

A dose of an antagonistic anti-CD40 antibody will also be given to the recipient about 8 days before transplantation and 7 and 14 days after transplantation. The dose will be at least about 30 mg anti-CD40 antibody per kg recipient body weight.

The recipient will receive the transplant. The transplant will be cells, tissues, and/or organ from non-human animals, including but not limited to ungulates.

For example, islet cells will be extracted from unmodified ungulates and transplanted into human recipients suffering from diabetes. Because the recipient has been properly tolerized before transplantation, the human recipients will not reject the transplant.

Example 17

Treating Diabetes by Transplanting Porcine Islets in Monkeys Receiving Anti-CD40 Antibody Treatment This example compared the effects of anti-CD40 antibody administered at different time points on immuno-rejection in monkeys transplanted porcine islets.

A control diabetic monkey was transplanted with non-genetically modified porcine islets (FIG. 22A). The monkey was given anti-CD40 antibody on the day of transplantation. Exogenous insulin (shown in gray bars) needed to maintain normal blood glucose level was reduced on the day of transplant and completely stopped on day 21. Blood glucose levels (shown in lines) became normal immediately after transplantation and continue to be normal despite discontinuation of insulin on day 21 in both monkeys. However, the blood glucose level went after day 100 and exogenous insulin is needed to maintain normal blood glucose level after day 125.

Porcine islets collected from wild-type pigs were transplanted to a diabetic monkey. After transplantation, a monkey was given anti-CD40 antibody treatment four times through day 14 after transplantation (FIG. 22B). Exogenous insulin (shown in gray bars) needed to maintain normal blood glucose level was reduced on the day of transplant and completely stopped on day 21. Blood glucose levels (shown in lines) became normal immediately after transplantation and continue to be normal despite discontinuation of insulin on day 21 in the monkey. The blood glucose level remained normal without exogenous insulin on day 250 (FIG. 22B) after transplantation.

Example 18

Immunotolerizing Diabetic Monkeys Transplanted with Monkey Islets by Antibodies and ECDI-Fixed Splenocytes This example compared the effects of anti-CD40 antibodies and tolerizing vaccines on immuno-rejection to allografts in a monkey (ID #13CP7). The results showed both the anti-CD40 antibodies and tolerizing vaccines effectively reduced the immuno-rejection in the monkey transplanted with monkey islets.

Figure 23A:
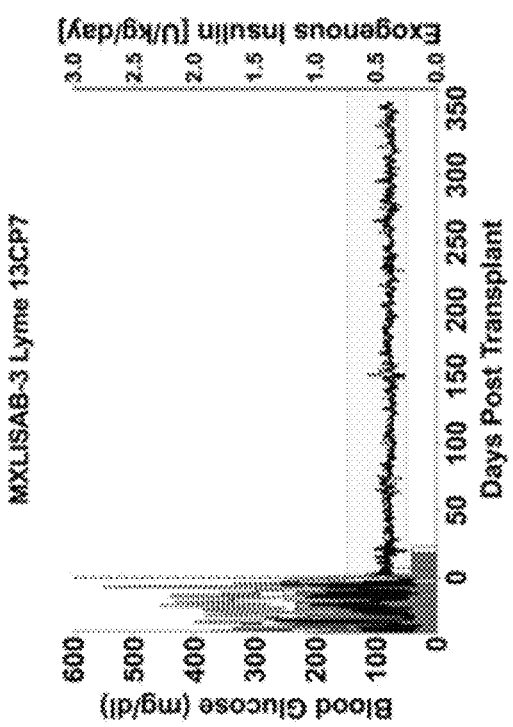
FIG. 23A demonstrates amelioration of diabetes (restoration of sustained normoglycemia and insulin independence) by transplanted porcine islets in a monkey (ID #13CP7) receiving maintenance immunosuppression with rapamycin and anti-CD40 antibody weekly after transplantation. The monkey was given an anti-CD40 antibody and rapamycin for 21 days starting from the day of transplantation.
Figure 23B:
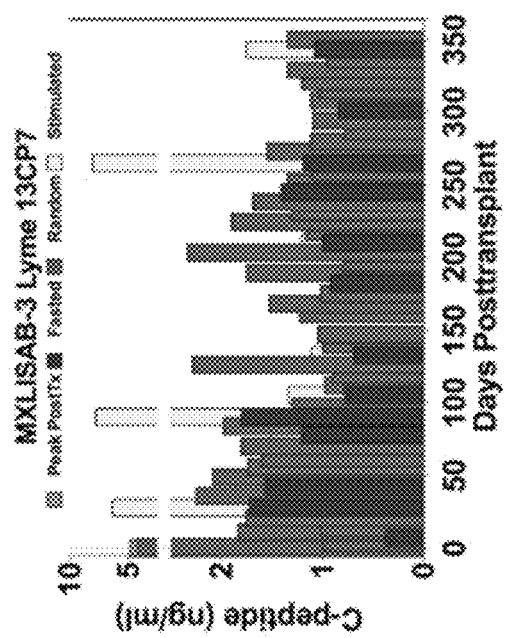
FIG. 23B demonstrates serum porcine C-peptide levels (fasted, random, and stimulated) in the same recipient (ID #13CP7).

A diabetic monkey was transplanted with monkey islets. The monkey was given an anti-CD40 antibody and rapamycin for 21 days starting from the day of transplantation. The monkey was given exogenous insulin up to 21 days after transplantation. After day 21, the monkey had normal blood glucose level in the morning (fasting), but high blood glucose level in the afternoon (FIG. 23A). FIG. 23B demonstrates serum porcine C-peptide levels (fasted, random, and stimulated) in the same recipient (ID #13CP7).

Example 19

Immunotolerizing Diabetic Monkeys Transplanted with Porcine Islets by α-CD40 Antibodies and CTLA4-Ig Experiments in this example compared the effects of α-CD40 antibodies and CTLA4-Ig on maintaining immunosuppression induced by other drugs in monkeys transplanted with porcine islet cells. The results showed that the α-CD40 antibodies outperformed CTLA4-Ig in extending islet xenograft survival (Table 12).

Two groups of cynomolgus monkeys with streptozotocin-induced diabetes (MX-LISA-A (4 monkeys) and MX-LISA-B (3 monkeys)) were intraportally transplanted with non-genetically modified porcine islets. For monkeys in the MX-LISA-A group, immunosuppression was induced by an α-CD25 antibody, an α-CD40 antibody, sTNFR, and an α-IL-6R antibody, and maintained by CTLA4-Ig and Rapamycin. For monkeys in the MX-LISA-B group, immunosuppression was induced by an α-CD25 antibody, CTLA4-Ig, sTNFR, and an α-IL-6R antibody, and maintained by an α-CD40 antibody and Rapamycin. Longer islet xenograft survival was achieved when the immunosuppression was maintained by the α-CD40 antibody (the MX-LISA-B group) compared to the MX-LISA-A group (Table 12).

TABLE 12

Immunotolerizing diabetic monkeys transplanted with porcine islets by α-CD40 antibodies and CTLA4-Ig.

| Group | n | ECDI-fixed Donor Splenocytes | Immunosuppression | | Islet Xenograft Survival (Days) |
|---|---|---|---|---|---|
| | | | Induction | Maintenance | |
| MX-LISA-A | 4 | None | α-CD25 + α-CD40 + sTNFR + α-IL-6R | CTLA4-Ig + Rapamycin | 77, 126, 135, 363 |
| MX-LISA-B | 3 | None | α-CD25 + CTLA4-Ig + sTNFR + α-IL-6R | α-CD40 + Rapamycin | ≥364, ≥365, ≥365 |

Example 20

Immunotolerizing Diabetic Monkeys Transplanted with Porcine Islets by α-CD40 Antibodies and ECDI-Fixed Donor Splenocytes This example examined the effects of apoptotic splenocytes on immuno-rejection in monkeys transplanted with porcine islets. The results showed that the apoptotic splenocytes extended islet xenograft survival (Table 13).

Two groups of cynomolgus monkeys with streptozotocin-induced diabetes (MX-ECDI-Control (2 monkeys) and MX-ECDI-Vaccine (3 monkeys)) were intraportally transplanted with non-genetically modified porcine islets. All of the monkeys were given an α-CD20 antibody, an α-CD40 antibody, sTNFR, an α-IL-6R antibody, and rapamycin from the day of transplantation through day 21 after the transplantation. Monkeys in the MX-ECDI-Vaccine group were also given peritransplant intravenous infusions of $0.25 \times 10^9$ per kg bodyweight apoptotic donor splenocytes 7 days before and 1 day after the transplantation. The splenocytes include those prepared from GGTA1 knockout pigs, and those infused under the cover of the αGal glycoconjugate GAS914, as described in Katapodis et al., J Clin Invest. 110(12):1869-187 (2002), which is incorporated by reference herein in its entirety. Prolonged islet xenograft survival was achieved in monkeys given apoptotic donor splenocytes under the cover of transient immunosuppression (MX-ECDI Vaccine) but not in recipients given transient immunosuppression only (MX-ECDI Control) (Table 13).

TABLE 13

Immunotolerizing diabetic monkeys transplanted with porcine islets by α-CD40 antibodies and apoptotic donor spenocytes

| Group | n | ECDI-fixed Donor Splenocytes | Transient Immuno-suppression | Islet Xenograft Survival (Days) |
|---|---|---|---|---|
| MX-ECDI-Control | 2 | None | α-CD40 + α-CD20 + sTNFR + α-IL-6R + Rapa Thru Day 21 | 32, 40 |
| MX-ECDI-Vaccine | 3 | 0.25 × 10$^9$ on days −7 and +1 | α-CD40 + α-CD20 + sTNFR + α-IL-6R + Rapa Thru Day 21 | 81, 100, 113 |

Example 21

Suppression of Circulating Immune Cells Levels by ECDI-Fixed Donor Splenocytes and α-CD40 Antibodies Experiments in this example examined ECDI-fixed cells (tolerizing vaccines) and α-CD40 antibodies on the level of circulating immune cells after transplantation. The levels of circulating immune cells were indicators of transplant rejection. The results showed that both ECDI-fixed cells (tolerizing vaccines) and α-CD40 antibodies decreased the levels of circulating immune cells in the recipients after transplantation.

The circulating immune cells tested here were CD8+ CD2hi CD28− effector memory T cells, CD4+CD25hi FoxP3+ CD127low regulatory T cells, and CD8+ CD122+ natural suppressor cells.

CD8+ CD2hi CD28− Effector Memory T Cells

Figure 24:
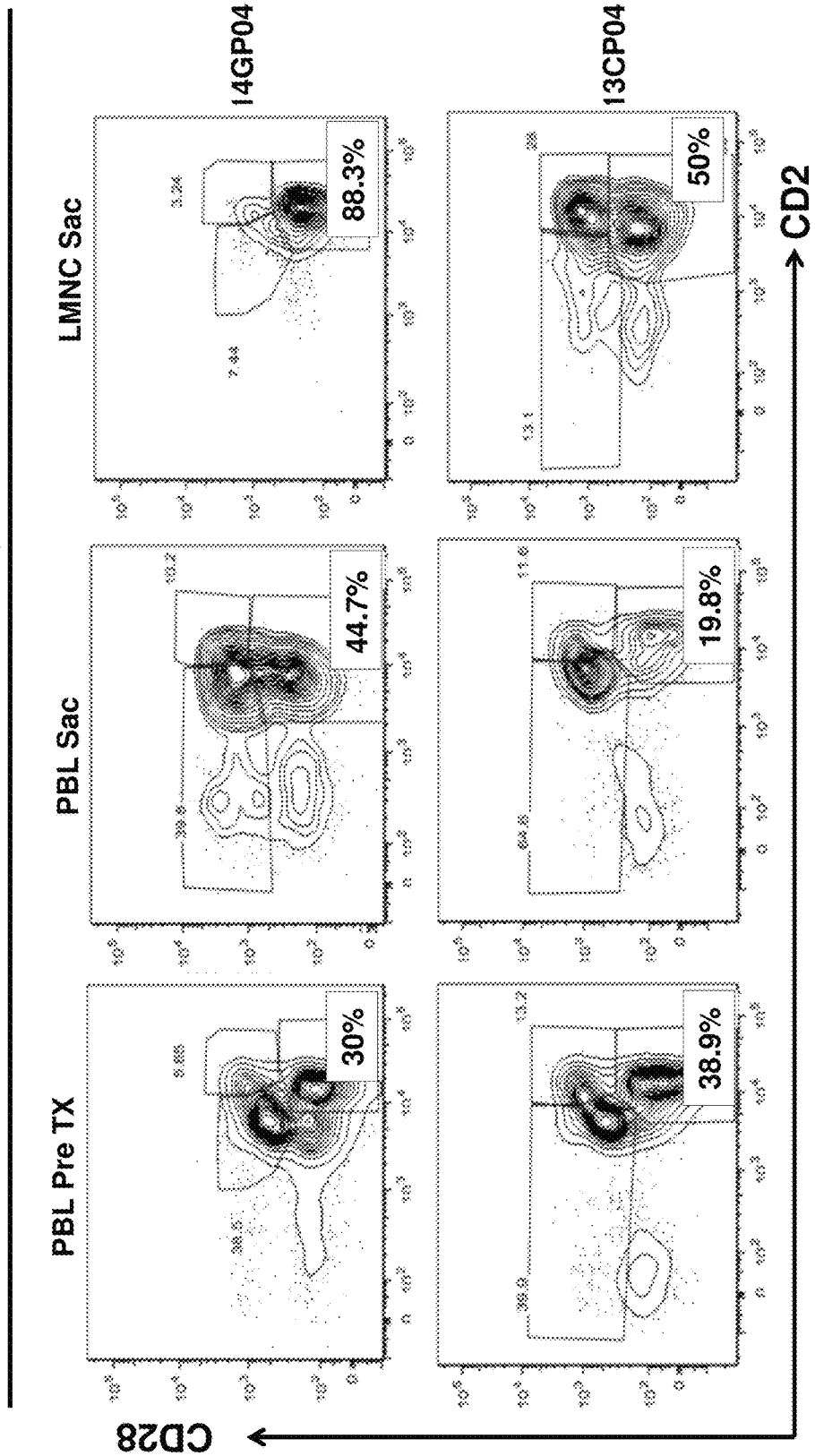
FIG. 24 shows the increase of circulating CD8+ CD2hi CD28− effector memory T cells in two cynomolgus monkeys at the time of sacrifice (after presumed rejection) compared with baseline and the high prevalence of CD8+ CD2hi CD28− effector memory T cells within the CD8+ T cell compartment in liver mononuclear cells at the time of sacrifice. Both monkeys received intraportal xenotransplants of adult porcine islets. Pre Tx: pretransplant; PBL: peripheral blood leukocyte; Sac: sacrifice; Lym: lymphocyte; LMNC: liver mononuclear cell.

Cynomolgus monkeys were transplanted with porcine islets. No tolerizing vaccine was given to the monkeys. The level of circulating CD8+ CD2hi CD28− effector memory T cells was determined by flow cytometry (FIG. 24). The results showed that the level of circulating CD8+ CD2hi CD28− effector memory T cells in the monkeys undergoing transplantation (14GP04) was increased compared with baseline control (13CP04), and the CD8+ CD2hi CD28− effector memory T cells have high prevalence within the CD8+ T cell compartment in liver mononuclear cells at the time of sacrifice (FIG. 24).

Figure 25:
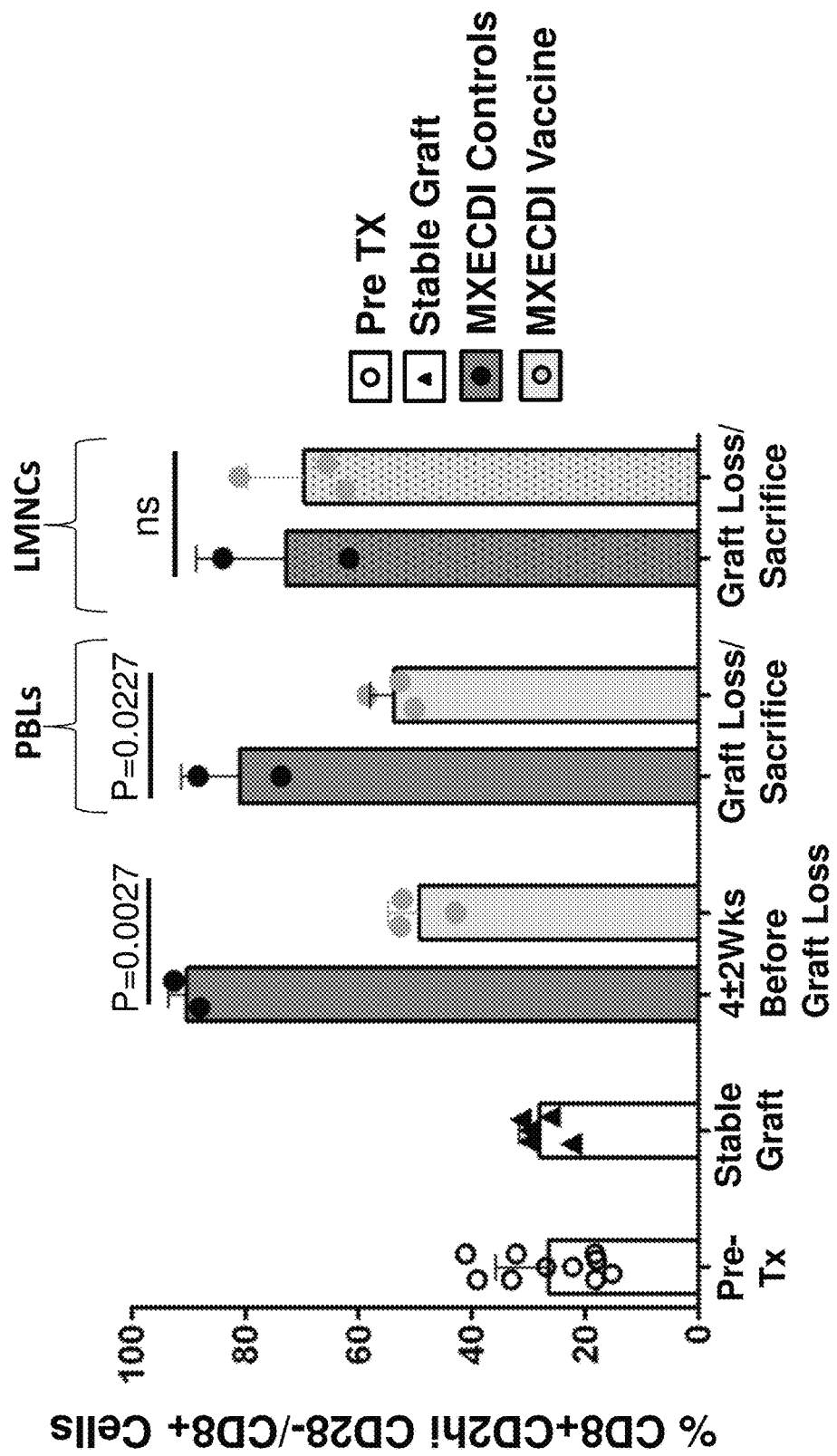
FIG. 25 shows suppression of circulating CD8+ CD2hi CD28− effector memory T cells by peritransplant infusion of apoptotic donor splenocytes (MX-ECDI-vaccine) compared with controls that received the same transient immunosuppression but no apoptotic donor splenocytes (MX-ECDI-controls). Pre Tx: pretransplant; Sac: sacrifice; Lym: lymphocyte; LMNC: liver mononuclear cell.

Circulating CD8+ CD2hi CD28− effector memory T cells in the two groups of cynomolgus monkeys (MX-ECDI-control and MX-ECDI-vaccine) transplanted with porcine islets in Example 24 were measured by flow cytometry. Monkeys in the MX-ECDI-vaccine groups received peritransplant infusion of apoptotic donor splenocytes as a tolerizing vaccine. The level of circulating CD8+ CD2hi CD28− effector memory T cells was determined by flow cytometry (FIG. 25). Flow cytometry results show that the peritransplant infusion of apoptotic donor splenocytes (MX-ECDI-vaccine) reduced at least temporarily the posttransplant increase of circulating CD8+ CD2hi CD28− effector memory T cells in the cynomolgus monkeys compared with control recipients that did not receive tolerizing vaccination with apoptotic donor splenocytes (MX-ECDI-control). At the time of sacrifice (after presumed rejection), the percentage of CD8+ CD8+ CD2hi CD28− effector memory T cells within the CD8+ T cell compartment in liver mononuclear cells was comparably high in both groups of recipients (FIG. 25).

Circulating CD8+ CD2hi CD28− effector memory T cells in monkeys transplanted with porcine islets in Examples 28 (MX-LISA-A and MX-LISA-B) and Example 29 (MX-ECDI-control and MX-ECDI-vaccine) were measured by flow cytometry on the day of transplantation, day 7, day 50, and day 100 after transplantation. The level of circulating CD8+ CD2hi CD28− effector memory T cells from naïve monkeys was used as a control.

Figure 26:
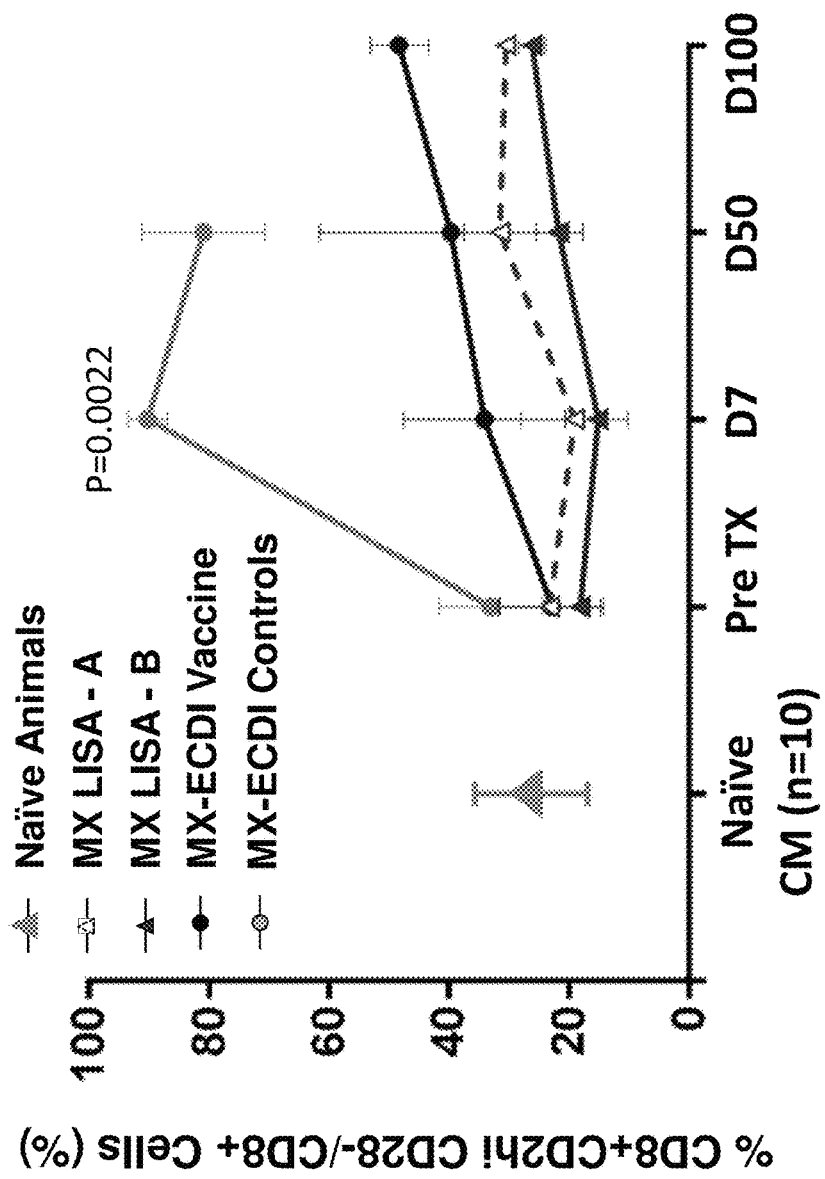
FIG. 26 shows suppression of circulating CD8+ CD2hi CD28− effector memory T cells by apoptotic donor splenocytes and α-CD40 antibodies. CM: cynomolgus monkey; Pre Tx: pretransplant; D: day.

Flow cytometry results show that the peritransplant infusion of apoptotic donor splenocytes (MX-ECDI vaccine) suppresses at least temporarily the posttransplant increase of circulating CD8+ CD2hi CD28− effector memory T cells in cynomolgus monkeys compared with control recipients that did not receive tolerizing vaccination with apoptotic donor splenocytes (MX-ECDI Control). The level of suppression of posttransplant increases in CD8+ effector memory T cells in MX-ECDI-vaccine recipients was comparable with the suppression in recipients that receive more potent and more prolonged immunosuppression after porcine islet xenotransplantation (the MX-LISA-A and MX-LISA-B groups) (FIG. 26).

CD4+CD25hi FoxP3+ CD127low Regulatory T Cells

The experiments in this example examined ECDI-fixed cells (tolerizing vaccines) and α-CD40 antibodies on the level of circulating CD4+CD25hi FoxP3+ CD127low regulatory T cells after transplantation. The level of circulating CD4+CD25hi FoxP3+ CD127low regulatory T cells was an indicator of transplant rejection.

Circulating CD4+CD25hi FoxP3+ CD127low regulatory T cells in monkeys transplanted with porcine islets (MX-LISA-A, MX-LISA-B, MX-ECDI-control, and MX-ECDI-vaccine) were measured by flow cytometry on the day of transplantation, day 7, day 50, and day 100 after transplantation. The level of circulating CD4+CD25hi FoxP3+ CD127low regulatory T cells from naïve monkeys was used as a control.

Figure 27:
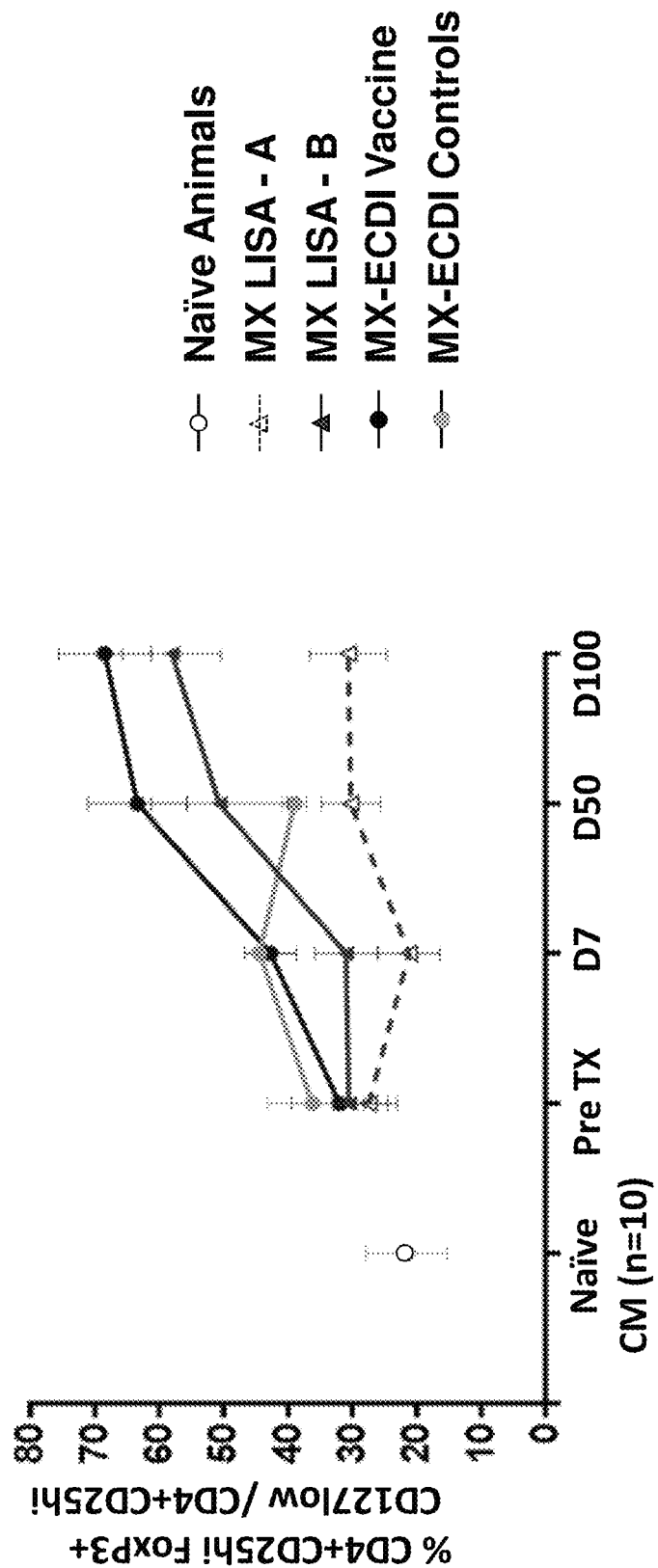
FIG. 27 shows suppression of circulating CD4+CD25hi FoxP3+ CD127low regulatory T cells by apoptotic donor splenocytes and α-CD40 antibodies. CM: cynomolgus monkey; Pre Tx: pretransplant; D: day.

Flow cytometry results show that the peritransplant infusion of apoptotic donor splenocytes (MX-ECDI-vaccine) promoted the increase in circulating CD4+CD25hi FoxP3+ CD127low regulatory T cells in cynomolgus monkeys compared with control recipients that did not receive tolerizing vaccination with apoptotic donor splenocytes (MX-ECDI-control). The posttransplant increase in these regulatory T cells in MX-ECDI-vaccine recipients was comparable with the increase in recipients that receive maintenance immunosuppression with anti-CD40 antibodies and rapamycin (MX-LISA-B) after porcine islet xenotransplantation (FIG. 27).

CD8+ CD122+ Natural Suppressor Cells

Circulating CD8+ CD122+ natural suppressor cells in monkeys transplanted with porcine islets (MX-LISA-A, MX-LISA-B, MX-ECDI-control, and MX-ECDI-vaccine) were measured by flow cytometry on the day of transplantation, day 7, day 50, and day 100 after transplantation. The level of circulating CD8+ CD122+ Natural Suppressor Cells from naïve monkeys was used as a control.

Figure 28:
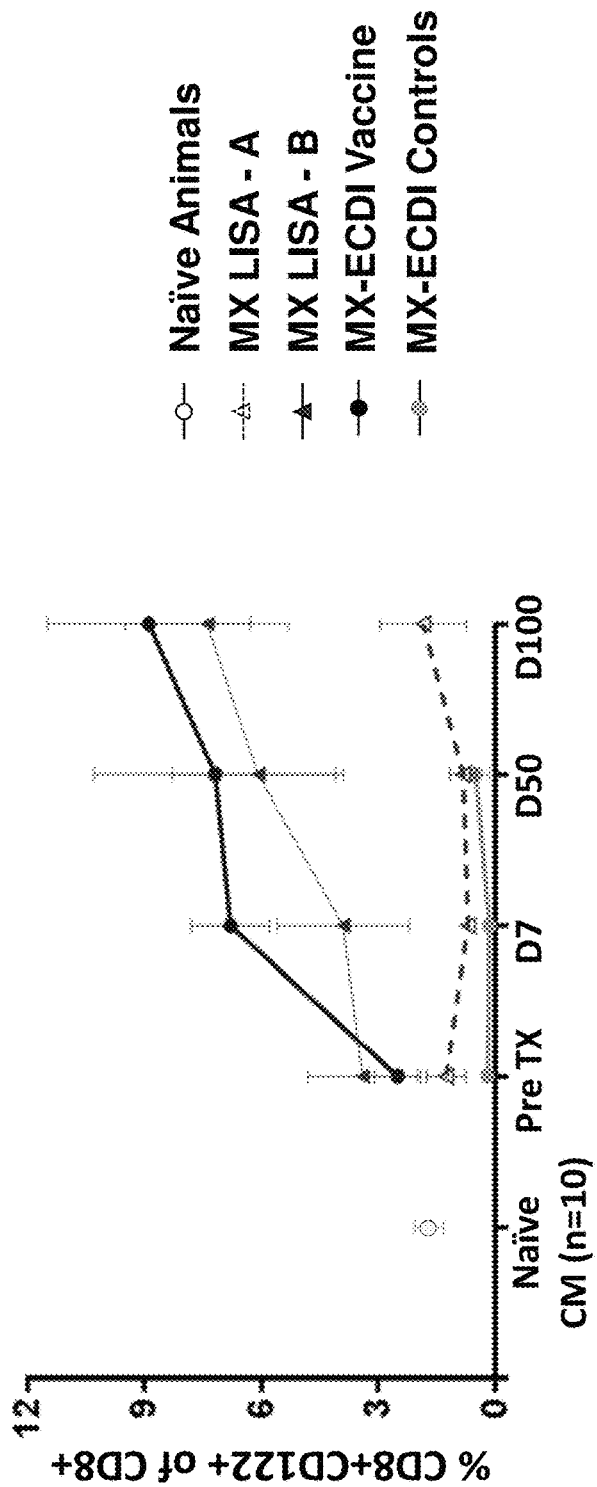
FIG. 28 shows suppression of circulating CD8+CD122+ natural suppressor cells by apoptotic donor splenocytes and α-CD40 antibodies. CM: cynomolgus monkey; Pre Tx: pretransplant; D: day.
Figure 29A:
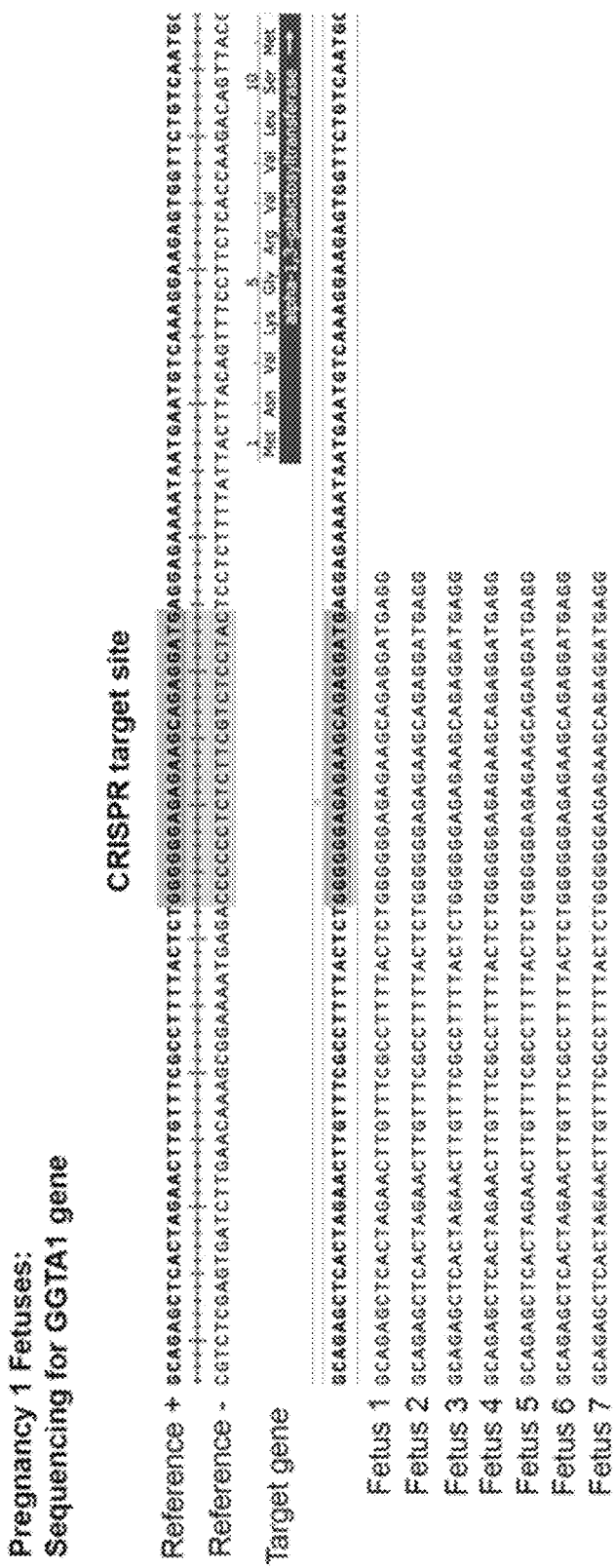
FIGS. 29A-29B show sequencing of DNA isolated from fetal cells of two separate litters (Pregnancy 1.
Figure 29B:
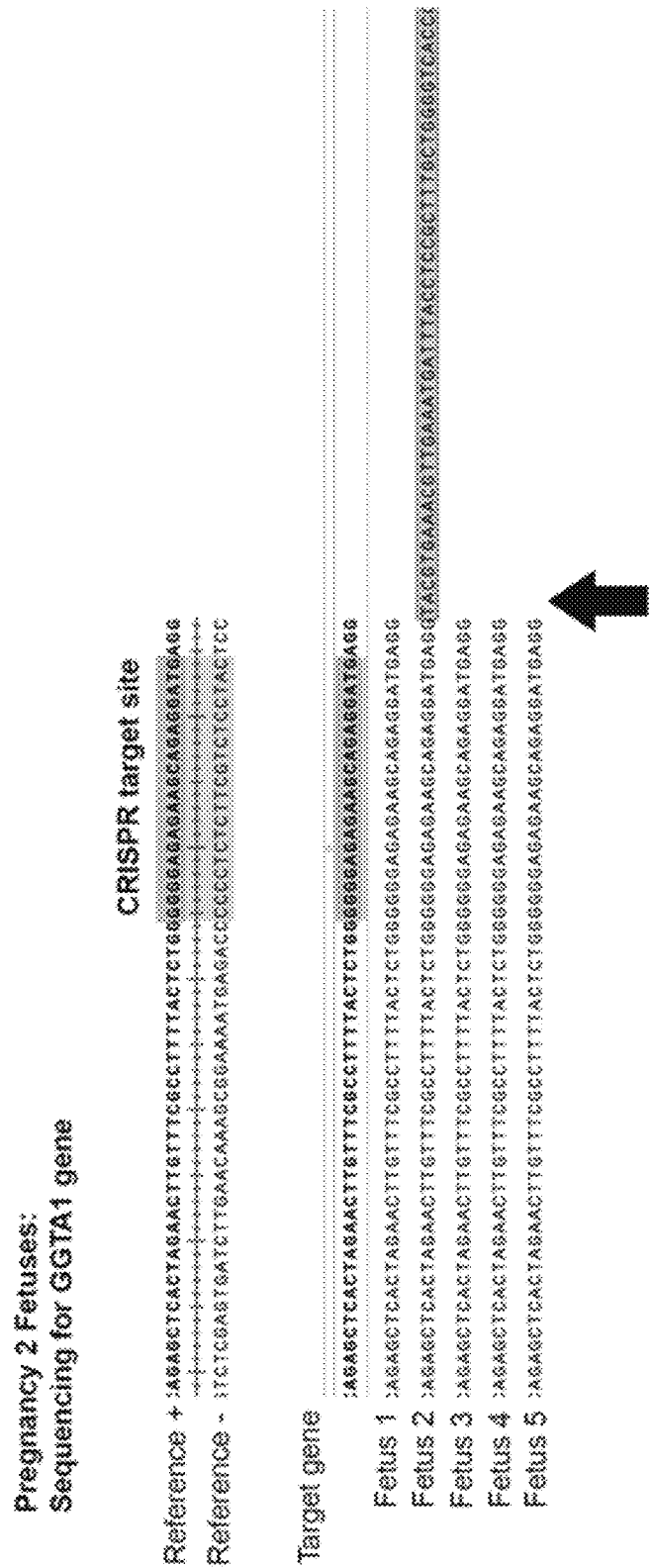

Flow cytometry results showing that the peritransplant infusion of donor apoptotic splenocytes (MX-ECDI-vaccine) promoted the increase in circulating CD8+ CD122+ natural suppressor cells in cynomolgus monkeys compared with control recipients that did not receive tolerizing vaccination with apoptotic donor splenocytes (MX-ECDI-control) and MX-LISA-A recipients. The posttransplant increased in these regulatory T cells in MX-ECDI-vaccine recipients is comparable with the increase in recipients that receive maintenance immunosuppression with anti-CD40 antibodies and rapamycin (MX-LISA-B) after porcine islet xenotransplantation (FIG. 28).

Example 22

Prolonging Pig Islet Xenograft Survival in Monkeys by ECDI-Fixed Cells, Rituximab, Anti-CD40 Ab 2C10 Antibody, sTNFR, Anti-IL-6R Antibody, and Rapamycin This example shows exemplary methods for suppressing immuno-rejection using ECDI-fixed donor cells in combination with other immunosuppression drugs.

The tolerogenic efficacy of the novel, tripartite protocol including peritransplant i) antigen delivery on ECDI-fixed cells, ii) rapamycin, rituximab, sTNFR, and anti-IL-6R antibody, and iii) anti-CD40 Ab 2C10 will be studied in the setting of intraportal transplantation of adult pig islets in monkeys.

ECDI-fixed donor splenocytes will be prepared from freshly prepared, cytokine-mobilized splenic B cells from cloned porcine donors. About $0.25 \times 10^9$/kg ECDI-fixed donor splenocytes will be administered via IV to the monkeys on day −7 (relative to same-donor islet transplant on day 0). Donor spleen will be freshly obtained from cloned porcine donors using splenectomy. Donor spleen B cells will be ex-vivo expanded and administered via IV infusion to the monkeys on day +1. Adult pig islet products (25,000 islet equivalents/kg) from cloned porcine donors, cultured for 7 days, and meeting all release criteria will be infused intraportally on day 0 via a portal venous vascular access port.

B cell depletion will be initiated with rituximab on day −10, i.e. prior to islet transplantation and also prior to the first infusion of ECDI-fixed donor cells. Four doses of 20 mg/kg will be administered via IV on day −10, −3, +5, and +12 to the monkeys. The monkeys will be administered rapamycin on day −7 through day 21 post-transplant with the 12 to 15 ng/ml target trough level. sTNFR will be subcutaneously administered on day −6 through day +10. Additionally, anti-IL-6R will be administered via IV on day −7, 0, 7, 14 and 21.

Monkeys will be tested to determine the efficacy of using pharmaceutically active agents together with ECDI-fixed donor cells in a xenotransplant animal model. Three doses of 50 mg/kg anti-CD40 Ab 2C10 will be administered to a monkey via IV on day −1, +7, and +14, while four doses of 50 mg/kg anti-CD40 Ab 2C10 will be administered to a different monkey via IV on day −8, −1, +7, and +14.

Post-transplant monitoring of graft functions, including daily am blood glucose (AM BG) and pm blood glucose (PM BG), weekly C-peptide, monthly HbA1c, and bi-monthly IVGTTs with determination of acute C-peptide responses to glucose and glucose disappearance rates, will be measured. Successful engraftment will be defined as maintenance of nonfasting BG<200 mg/dL on greatly reduced (≤33% of baseline) or no exogenous insulin. The primary efficacy outcome will be days to islet graft failure as defined as the first of 3 consecutive days (on stable low dose insulin or after discontinuation of insulin) with blood glucose levels ≥200 mg/dL.

The islet graft function post-transplant will be further demonstrated in the IV glucose tolerance test (IVGTT). A dose of glucose will be ingested by IV and blood levels are checked at intervals. Serum porcine C-peptide responses to IV glucose before and after diabetes induction (pre and post STZ) will also be measured. A response to IV glucose at day +28 will indicate the reversal of the induced diabetic condition.

Example 23

Reducing Immuno-Rejection in a Recipient by Transplanting Genetically Modified Transplant Grafts and Administering ECDI-Fixed Donor Cells This example shows exemplary methods for suppression of immuno-rejection in a recipient receiving a transplant from a donor by i) administering ECDI-fixed donor cells; and ii) genetically modifying the donor so that the transplant will induce low or no immuno-rejection in the recipient.

A human recipient in need of transplantation is tolerized to the graft by treating the recipient with ECDI fixed cells. After tolerization, the recipient will receive a transplant. The transplant will be cells, tissues, and/or organ from non-human animals, including but not limited to ungulates. These non-human animals will be genetically modified non-human animals. The genetic modification will include at least NLRC5/TAP1 knockout. Other genes that will be knocked out are listed in Tables 1 and 2. Genes that will be overexpressed are listed in Tables 3 and 4.

For example, a human recipient with diabetes is transplanted with one or more NLRC5/TAP1 knockout islet cells overexpressing ICP47. The transplanted islet cells will over-express a transgene coding a peptide homologous or identical to human ICP47. The islet cells will be from a genetically modified non-human animal, such as a pig.

Following the transplantation, the human recipient will have increased endogenous insulin levels and better glucose tolerance. When compared to a human recipient who is transplanted with wild-type islet cells, the human recipient transplanted with NLRC5 knockout islet cells overexpressing human ICP47 will have significantly reduced transplant rejection, thus requiring little to no immunosuppression therapy.

Example 24

Preventing Rejection or Extending Survival of Porcine Islet Xenografts in Human Recipients in the Clinical Setting in the Absence of Chronic and Generalized Immunosuppression of the Recipients This example shows an exemplary approach to preventing rejection or extending survival of porcine islet (and/or other cell, tissue, and organ) xenografts in human recipients in the clinical setting in the absence of chronic and generalized immunosuppression of the xenograft recipient. This approach will include and integrate three components: i) genetically engineered porcine islets with deficient and/or reduced expression of αGal, MHC class I, complement C3, and CXCL10 as well as transgenic expression the HLA-G; ii) genetically engineered donor apoptotic and non-apoptotic mononuclear cells (e.g., splenocytes) with deficient/reduced expression of αGal, Neu5Gc, and Sda/CAD as well as transgenic expression of HLA-G with or without human CD47, human PD-L1, human PD-L2 (the genetically engineered vaccine); and iii) the administration of transient immunosuppression including antagonistic anti-CD40 mAb, anti-CD20 mAb, rapamycin and transient anti-inflammatory therapy including compstatin (e.g., the compstatin derivative APL-2), anti-IL-6 receptor mAb, and soluble TNF receptor.

Vaccine donor pigs comprising disrupted GGTA1, CMAH, and B4GalNT2 and transgenes expressing HLA-G (or HLA-E), human CD47, human PD-L1 and human PD-L2 will be generated. These vaccine donor pigs will provide mononuclear cells (e.g., splenocytes) with αGal-, Neu5Gc-, Sda/CAD-Deficiencies and expressing of HLA-G, human CD47, human PD-L1, and human PD-L2. Some of the mononuclear cells (e.g., splenocytes) will be made apoptotic by ECDI fixation. Apoptotic and non-apoptotic mononuclear cells (e.g., splenocytes) will be mixed to make tolerizing vaccines. The graft donor pigs will be made by further disrupting NLRC5 (or TAP1-), C3, and CXCL10 genes in the vaccine donor pigs. The graft donor pigs will provide cells, tissues or organs (e.g., islets) for transplant in a human recipient. The populations of vaccine donor pigs and graft donor pigs will be expanded by cloning, e.g., using somatic nuclear transfer.

A graft from the graft donor pigs will be transplanted to a recipient. Tolerizing vaccines from cells provided by the vaccine donor pigs will administered to the human recipient one day before and 7 days after transplant. Immunosuppression agents such as α-CD40 antibodies, α-CD20 antibodies and Rapamycin, and/or anti-inflammatory agents such as compstatin, α-IL-6R antibodies, and sTNFR will be administered from a time point before transplant through day 21 after transplant. This approach will prevent rejection or extending survival of porcine xenograft (e.g., porcine islets) in the human recipient in the absence of chronic and generalized immunosuppression of the recipient (FIG. 5).

Example 25

Generation and Characterization of GGTA1/NLRC5 Knockout Pigs

This example shows exemplary methods for generating knockout pigs. A knockout pig can have reduced protein expression of two or more of the following: NLRC5, TAP1, C3, CXCL10, MICA, MICB, CIITA, CMAH, GGTA1 and/or B4GALNT2. One of such knockout pig was a GGTA1/CMAH/NLRC5 knockout pig using CRISPR/cas9 system. The pigs provided islets for transplantation. Porcine islets with disrupted GGTA1/CMAH/NLRC5 had MHC class I deficiency and will induce low or no immuno-rejection when transplanted to a recipient.

Transfection of Fetal Fibroblasts

The px330 plasmids expressing guide RNA targeting GGTA1, CMAH, and NLRC5 generated in Example 1 were transected in porcine fetal fibroblasts. Pig fetal fibroblasts were cultured in DMEM containing 5-10% serum, glutamine and penicillin/streptomycin. The fibroblasts were co-transfected with two or three plasmids expressing Cas9 and sgRNA targeting the GGTA1, CMAH or NLRC5 genes using Lipofectamine 3000 system (Life Technologies, Grand Island, N.Y.) according to the manufacturer's instructions.

Counter-Selection of GGTA1 KO Cells

Four days after transfection, the transfected cells were harvested and labeled with isolectin B4 (IB4)-biotin. Cells expressing αGal were labeled with biotin conjugated IB4 and depleted by streptavidin coated Dynabeads (Life Technologies) in a magnetic field. The αGal deficient cells were selected from the supernatant. The cells were examined by microscopy. The cells containing no or very few bound beads after sorting were identified as negative cells.

DNA Sequencing Analysis of the CRISPR/Cas9 Targeted GGTA1 and NLRC5 Genes

Genomic DNA from the IB4 counter-selected cells and cloned pig fetuses were extracted using Qiagen DNeasy Miniprep Kit. PCR was performed with GGTA1 and NLRC5 specific primer pairs as shown in Table 11. DNA polymerase, dNTPack (New England Biolabs) was used and PCR conditions for GGTA1 were based on annealing and melting temperature ideal for those primers. The PCR products were separated on 1% agarose gel, purified by Qiagen Gel Extraction Kit and sequenced by the Sanger method (DNA Sequencing Core Facility, University of Minnesota) with the specific sequencing primers as shown in Table 7.

Somatic Cell Nuclear Transfer (SCNT)

SCNT was performed as described by Whitworth et al. *Biology of Reproduction* 91(3):78, 1-13, (2014). The SCNT was performed using in vitro matured oocytes (DeSoto Biosciences Inc., St. Seymour, Tenn.). Cumulus cells were removed from the oocytes by pipetting in 0.1% hyaluronidase. Only oocytes with normal morphology and a visible polar body were selected for SCNT. Oocytes were incubated in manipulation media (Ca-free NCSU-23 with 5% FBS) containing 5 µg/mL bisbenzimide and 7.5 µg/mL cytochalasin B for 15 min. Oocytes were enucleated by removing the first polar body plus metaphase II plate. A single cell was injected into each enucleated oocyte, fused, and activated simultaneously by two DC pulses of 180 V for 50 µsec (BTX cell electroporator, Harvard Apparatus, Hollison, Mass., USA) in 280 mM Mannitol, 0.1 mM $CaCl_2$, and 0.05 mM $MgCl_2$. Activated embryos were placed back in NCSU-23 medium with 0.4% bovine serum albumin (BSA) and cultured at 38.5° C., 5% $CO_2$ in a humidified atmosphere for less than 1 hour, and transferred into the surrogate pigs.

Producing Genetically Modified Pigs Using Embryos

Embryos for transferring to the surrogate pigs were added to a petri dish filled with embryo transferring media. A 0.25 ml sterile straw for cell cryopreservation was also be used. Aspiration of embryos was performed at 25-35° C.

Aspiration of embryos was performed following this order: media layer-air layer-media layer-air layer-embryo layer-air layer-media layer-air layer-media layer. When the straw sterilized with EO gas was used, its interior was washed by repeating aspiration and dispensing of the medium for embryo transplantation 1-3 times, before aspiration of embryos. After the aspiration, the top end of straw was sealed by a plastic cap. To keep the aspirated and sealed straw sterile, a plastic pipette (Falcon, 2 ml) was cut in a slightly larger size than the straw, put therein, and sealed with a paraffin film. The temperature of the sealed straw was maintained using a portable incubator, until shortly before use.

Embryos and estrus-synchronized surrogate mothers were prepared. Transferring of embryos will be performed by exposing ovary through laparotomy of the surrogate mothers. After anesthetization, the mid-line of the abdominal region was incised to expose the uterus, ovary, oviduct, and fimbriae. The straw aspirating embryos were aseptically taken from the portable incubator, and inserted into the inlet of oviduct. The inserted straw was moved up to the ampullary-isthmic junction region. After the insertion procedure, the straw was cut at the air containing layer on the opposite using scissors. A 1 cc syringe was mounted on the cut end, and approximately 0.3 cc of air was injected to release the embryos and medium from the straw into the oviduct. At this time, 5 mm of the top end of a 0.2 ml yellow tip was cut off and used to connect the syringe and straw.

After the embryo transfer, the exposed uterus, ovary, oviduct, and fimbriae were put in the abdominal cavity, and the abdominal fascia was closed using an absorbable suture material. Then, the surgical site was cleaned with Betadine, and treated with antibiotics and anti-inflammatory and analgesic drugs. A pregnancy test of the surrogate mother transplanted with embryos was performed, followed by induction of delivery of non-human animals that successfully got pregnant.

Pregnancy and Fetuses

Two litters of pig fetuses (7 from pregnancy 1 and 5 from pregnancy 2) were obtained. Fetuses were harvested at day 45 (pregnancy 1) or 43 (pregnancy 2) and processed for DNA and culture cell isolation. Tissue fragments and cells were plated in culture media for 2 days to allow fetal cells to adhere and grow. Wild type cells (fetal cells not genetically modified) and fetal cells from pregnancy 1 or 2 were removed from culture plates and labeled with IB4 lectin conjugated to alexa fluor 488 or anti-porcine MHC class I antibody conjugated to FITC. Flow cytometric analysis was performed and data shown in FIGS. 32A-32C: Pregnancy 1 or FIGS. 32D-32E: Pregnancy 2. The histogram for the WT cells are included in each panel to highlight the decrease in overall intensity of each group of fetal cells. Of specific interested is the decrease in alpha Gal and MHC class I labeling in pregnancy 1 indicated as a decrease in peak intensity. In pregnancy 2 fetus 1 and 3 have a large decrease in alpha gal labeling and significant reduction in MHC class 1 labeling as compared to WT fetal cells.

Genotypes of the Fetuses

DNA from fetal cells was subjected to PCR amplification of the GGTA1 (compared to *Sus scrofa* breed mixed chromosome 1, Sscrofa10.2 NCBI Reference Sequence: NC 010443.4) or NLRC5 (consensus sequence) target regions and the resulting amplicons were separated on 1% agarose gels (FIGS. 29A, 29B, 30A, and 30B). Amplicons were also analyzed by sanger sequencing using the forward primer alone from each reaction. The results are shown as Pregnancy 1 fetuses 1, 2, 4, 5, 6, and 7 truncated 6 nucleotides after the target site for GGTA1. Fetus 3 was truncated 17 nucleotides after the cut site followed by a 2,511 (668-3179) nucleotide deletion followed by a single base substitution. Truncation, deletion and substitution from a single sequencing experiment containing the alleles from both copies of the target gene can only suggest a gene modification has occurred but not reveal the exact sequence for each allele. From this analysis it appears that all 7 fetuses contained a single allele modification. Sequence analysis of the NLRC5 target site for fetuses from pregnancy 1 was unable to show consistent alignment suggesting an unknown complication in the sequencing reaction or varying DNA modifications between NLRC5 alleles that complicate the sanger sequencing reaction and analysis. Pregnancy 2 fetal DNA samples 1, 3, 4, and 5 were truncated 3 nucleotides from the GGTA1 gene target site. Fetus 2 had variability in sanger sequencing that suggests a complex variability in DNA mutations or poor sample quality. However, fetal DNA template quality was sufficient for the generation of the GGTA1 gene screening experiment described above. NLRC5 gene amplicons were all truncated 120 nucleotides downstream of the NLRC5 gene cut site.

Figures 31A, 31B:
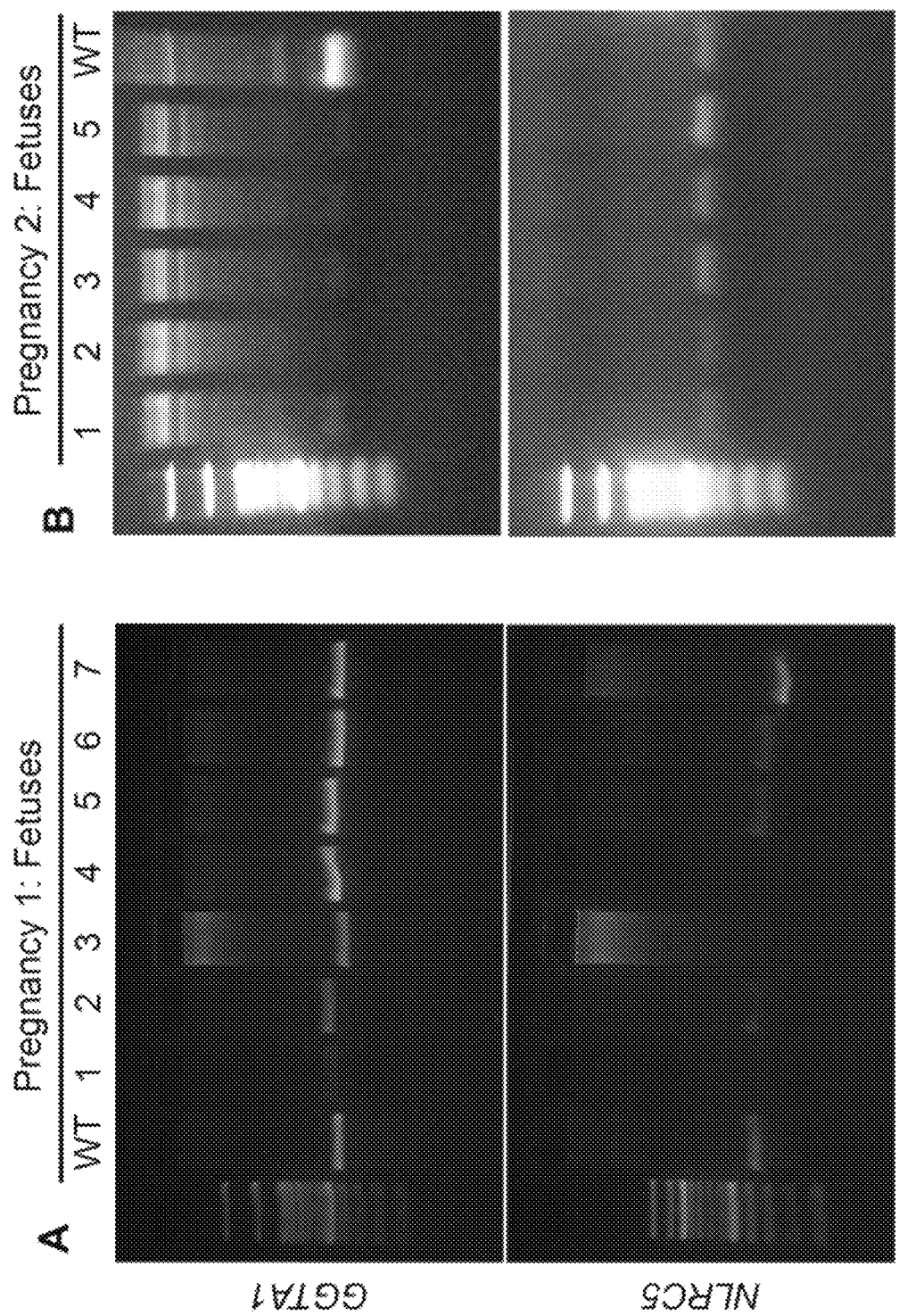
FIGS. 31A-31B show data from fetal DNA (wt and 1-7 (FIG. 31A: Pregnancy 1) or 1-5 (FIG. 31B: Pregnancy 2) isolated from hind limb biopsies. Target genes were amplified by PCR and PCR products were separated on 1% agarose gels and visualized by fluorescent DNA stain. The amplicon band present in the wt lanes represent the unmodified DNA sequence. An increase or decrease in size of the amplicon suggests an insertion or deletion within the amplicon, respectively. Variation in the DNA modification between alleles in one sample may make the band appear more diffuse. Pregnancy 1 (FIG. 31A) resulted in 7 fetuses while pregnancy 2 (FIG. 31B) resulted in 5 fetuses harvested at 45 and 43 days, respectively. A lack of band as in the NLRC5 gel in fetuses 1, 3, and 4 of FIG. 31A (bottom gel), suggests that the modification to the target region have disrupted the binding of DNA amplification primers. The presence of all bands in GGTA 1 in FIG. 31A (top gel) suggests that DNA quality was sufficient to generate DNA amplicons in the NLRC5 targeting PCR reactions. Fetuses 1, 2, 4, and 5 of Pregnancy 1 (FIG. 31A) have larger GGTA 1 amplicons than the WT suggesting an insertion within the target area. In fetus 3 of Pregnancy 1 (FIG. 31A), the GGTA 1 amplicon migrated faster than the WT control suggesting a deletion within the target area. Fetuses 6 and 7 of Pregnancy 1 (FIG. 31A) NLRC5 amplicons migrated faster than the WT suggesting a deletion within the target area. Fetuses 1-5 (FIG. 31B) GGTA1 amplicons were difficult to interpret by size and were diffuse as compared to the WT control. Fetuses 1-5 (FIG. 31B) NLRC5 amplicons were uniform in size and density as compared to the wild type control.

Fetal DNA (from wild type (WT) controls, and fetuses 1-7 from pregnancy 1) was isolated from hind limb biopsies and the target genes NLRC5 and GGTA were amplified by PCR. PCR products were separated on 1% agarose gels and visualized by fluorescent DNA stain. The amplicon bands in the WT lane represent unmodified DNA sequence. An increase or decrease in size of an amplicon suggested an insertion or deletion within the amplicon, respectively. Variations in the DNA modification between alleles in one sample might make the band appear more diffuse. Minor variations in the DNA modification were possible to resolve by a 1% agarose gel. The results are shown in FIGS. 31A-31B. A lack of band as in the NLRC5 gel (fetuses 1, 3, and 4 of Pregnancy 1; FIG. 31A bottom) suggested that the modification to the target regions was disrupted the binding of DNA amplification primers. The presence of all bands in GGTA1 targeting experiment suggests that DNA quality was sufficient to generate DNA amplicons in the NLRC5 targeting PCR reactions. Fetuses 1, 2, 4, and 5 of Pregnancy 1 (FIG. 31A, top) had larger GGTA1 amplicons, suggesting an insertion within the targeted area. For fetus 3 of Pregnancy 1 (FIG. 31A, top), the GGTA1 amplicon migrated faster than the WT control, suggesting a deletion within the targeted area. For fetuses 6 and 7 of Pregnancy 1 (FIG. 31A, bottom), the NLRC5 amplicons migrated faster than the WT, suggesting a deletion with in the target area. Fetuses 1-5 of Pregnancy 2, (FIG. 31B, top) GGTA1 amplicons were difficult to interpret by size and were diffuse as compared to the WT control. Fetuses 1-5 (FIG. 31B, bottom) NLRC5 amplicons were uniform in size and density as compared to the wild type control.

Given the variation in phenotypic results for the alpha Gal and MHC class 1 flow cytometric labeling there is considerable variation in the bi-allelic mutations in the GGTA1 and NLRC5 genes. This observation is supported by differences in band size in the agarose gels, truncated gene products, and sequencing challenges FIGS. 29A-29B, 30A-30B, 31A-31B, and 32A-32E. Cloning of individual alleles will be performed to fully decipher the sequence modifications. However, the phenotypic, DNA sequencing, and functional analysis of fetuses support the creation of biallelic GGTA1 and NLRC5 gene modifications in fetal pigs.

Impact of Gene Knockout on Proliferation of Human Immune Cells

Next, with cells from fetus 3 of pregnancy 1, co-culture assays were performed to evaluate the impact of decreased MHC class I expression on proliferation of human immune cells.

Mixed Lymphocyte Reaction (MLR)

Co-cultures were carried out in flat-bottom, 96-well plates. Human PBMCs labeled with Carboxyfluorescein succinimidyl ester (CFSE) (2.5 µM/ml), were used as responders at $0.3$-$0.9\times10^5$ cells/well. Wild type or Porcine fibroblasts at $0.1$-$0.3\times10^5$ cells/well (from wild type pigs or the GGTA1/NLRC5 knockout fetuses) were used as stimulators at stimulator-responder ratios of 1:1, 1:5 and 1:10. MLR co-cultures were carried out for 4 days in all MLR assays. In another parallel experiment, total PBMCs cells were stimulated with phytohaemagglutinin (PHA) (2 ug/ml) as positive control.

Cultured cells were washed and stained with anti-CD3 antibody, anti-CD4 antibody and anti-CD8 antibody followed by formaldehyde fixation and washed. BD FACS Canto II flow cytometer was used to assess the proliferative capacity of CD8+ and CD4+ T cells in response to fibroblasts from the GGTA1/NLRC5 knockout fetus compared to unmodified porcine fibroblast cells. Data were analyzed using FACS diva/Flow Jo software (Tri star, San Diego, Calif., USA), and percentage CFSE dim/low was determined on pre gated CD8 T cells and CD4 T cells.

The proliferative response of human CD8+ cells and CD4+ T cells to wild type and GGTA1/NLRC5 knockout fetal cells are shown in FIGS. 33A-33C. Cells were gated as CD4+ or CD8+ before assessment of proliferation (FIG. 33A). CD8 T cell proliferation was reduced following treatments stimulation by fetal cells with GGTA1/NLRC5 knockout fibroblasts compared to wild type fetal cells. Almost 55% reduction in CD8+ T cells proliferation was observed when the human responders were treated with GGTA1/NLRC5 knockout fetal cells at 1:1 ratio (FIG. 33B). Wild type fetal cells elicited 17.2% proliferation in human CD8+ T cells whereas the GGTA1/NLRC5 knockout fetal cells from fetus 3 (pregnancy 1) induced only 7.6% proliferation (FIG. 33B). No differences were observed in CD8+ T cells proliferative response at 1:5 and 1:10 ratio compared to the wild type fetal cells (FIG. 33B). No changes were observed in CD4+ T cell proliferation in response to GGTA1/NLRC5 knockout compared to the wild type fetal cells (FIG. 33C).

While some embodiments have been shown and described herein, such embodiments are provided by way of example only. Numerous variations, changes, and substitutions will now occur to those skilled in the art without departing from the invention. It should be understood that various alternatives to the embodiments of the invention described herein will be employed in practicing the invention.

SEQUENCE LISTING (310 sequences)

SEQ ID NO: 1 - DNA, 20 bp, Artificial Sequence
  Description of Artificial Sequence: Synthetic primer
gctgtggcatatggcagttc

SEQ ID NO: 2 - DNA, 19 bp, Artificial Sequence
  Description of Artificial Sequence: Synthetic primer
tccatgtataagtctttta

SEQ ID NO: 3 - DNA, 20 bp, Artificial Sequence
  Description of Artificial Sequence: Synthetic primer
ggcaatgccagatcctcaac

SEQ ID NO: 4 - DNA, 20 bp, Artificial Sequence
  Description of Artificial Sequence: Synthetic primer
tgtctgatgtctttctcatg

SEQ ID NO: 5 - DNA, 2662 bp, Sus scrofa
  modified_base (616)..(715): a, c, t, g, unknown or other
  modified_base (800)..(899): a, c, t, g, unknown or other
  modified_base (1792)..(1792): a, c, t, g, unknown or other
tggaaacaacatgaacactgtgagctcccgggagttcagtcagatccactgaggtagtggccgggtccagcggccttgcctaacttggcagtccccacccgctgcatccttagatctggctttgtcccttacacaggacagcccaggcctgtgatccccaaggtcaggctaacgctacctggacctgggctctaagacctgggaagctacaggaggggtgagccagttcccagattgggaaaactgaggcttgaggcgagaggatagtcatccacaagcctcgtggctaaatccctggcttggcccagggccctggacctcaggccactgggctgatcagtgcttgtatgctttcctcatcgcacttgtttggaagacattccctggtttagctgctctgggatggtaatctataaatacatactttgtttaaaaaattaataaattaaatcttggaccagcatgagggcatctggccagccacatggcatatgacatggacatttgccacgtctcaaatatggactgcccatcacatgtagtgctaggacccatgccaacaacccacaggccacactgcaggtttcatgcaatgtcacatggaacgctgccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgccacgacatcctcactgtgctgcatattcccgactggtcatgcatgtcatgtgtgatggagggtggtctgttggccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgaagaccgtgcctggaaaacggcgtctctccctcccggaacagtgtgccgggacagccagctgaggctcttttcctgagccctctatcctgggggatggaagcggacatcacttggctgtattggaagggtcttgcgggggccgtcaagcatcccaggggacctgtggctgatggtcgaagaaagcaaagtccagcctgggctcccggctctgcagatgctgggccgtgtcctgggggatggggttattccacaggctgcggggcacagagacagacattcagcactgggagctgttcacttgtccttgtctctaccctctgtccaacccacagatggggaaactgaggccccaaaggggaagagctgttcccagagttacctggcaggtaggagcaggtgttagaccagcatggctaccttagggagatggtatcccccatgcccaccccaacttcttccactcactcttcttccctggaagctagtgatgccagctgggccatgctcatatgacacattgtgcaaataaggagaaagcccccccctttatttctttttgttttttttttttttaccatttcttgggccgctcccgcggcatatggagattcccaggctaggggtcgaatcggagctgtagccgccagcctacgccagagccacagcaactcgggatccgagctgcatctgcgacctgcaccacagctcatggcaacgccggatcgttaacccactgagcagggccagggatcgaacccgcaacctcatggttcctagttggattcattaaccactgtgccacgatgggaactctgaaagctccccctttttagacactttatttctatcttctgaaactgtcatactgagttttatagagcgagaccnccccctttttaagacactttatttctatcttctgaaactgtcgtaatatactgagttttatagagcgagacccttcactactaccagaaacctaacacgtcaacggtgtgaacagtgtcctttagatgcaaggccttggtacagtgtgcagcctgtgcaactgtacgtggtggctgtgattacagttatcattttaagcacttgctatgtgccaggcattgtactcagtgctttgtagaatcatttagtctgcagagcgcccatctaaggctgatatgatcattgtctccagtttacaaatgaggaaaccgaggttcagggaggttgagttactgaggcaaagttacacagtcagcaaccagtagagctgggatttgatccaggtctgctggctgccacattcctggtggagtgggccaaatctcctttgataatccccaatccaggagttcctgttgtggcgcagcagaaatgaatccgactagtaaccataaggttgcaggttcaatccctggtcttgctcagtgggttaaggatctggcgttgctatgagctgtggtgtaggttgaagatgcacctcagatcccacaatgctgtggctatggcgtaggctggcggatgtagctctgattggacccctagcctgggaatctccatatgctgcaggtgcggccctaaaaaagcaataaataagtaaatagataaccctcaacccaggtcctgcctcctcctacagaaagttcctttgcattgtagaggctgctgtggcccccacctcccaccatcctcgcccctgcaagtcctgttaccgaatgacttggatgccagagccctgagccagcccttcagccaggagccaggctccatgag

SEQ ID NO: 6 - DNA, 6638 bp, Sus scrofa
gggcctgtcctatggaaagaacctgcaagtccagcacaggggcttggccgggaacccatgagaccccctctggggacatcctaggacatctgtgatgaatcaggaagcagggctggctcctcatggaccccattagtcgccacctgggcaccaagaacctgtggggatggctcgtgaggctgctctgcaaacactcagaatggctgagtgccaaggtgaagttcttcctccccaacatggacctgggtgccaggaacgaggcctcagaccccacacagagggtcgtcctacaactcagaaaactgcgtacccagagtcagatcacctggcaggcgttcatccactgtgtgtgcatggagctggacgtgccgctggacctggaggtactgctgctgagcacctggggccacggagaagggctccccagtcagctggaagctgatgaggagcacccacctgagtctcagccccactctggcctcaagcggccacatcagagctgtgggccctcccctcgcccaaagcagtgcaggaagcagcagcgagaactggccaagaggtacctgcagctgctgagaacgtttgcccagcagcgttacgacagcaggagccctgggccaggacagccggtcgcctgccaccgaacctacatcccgcccatcttgcaatggaaccgagcctctgtgcccttcgacactcaggaggggactgttgcagggggccccaaggcagaagatggcacggatgtgagcattcgggacctcttcagtgccaaagccaacaagggcccgagagtcacggtgcttctgggaaaggcgggcatgggcaagaccacgctggcccaccggctctgccaagagtgggccgatggtcagctggagcgcttccaggccctgttccttttcgaattccgccagctcaacctgatcacaaacttcctgatgctgccacagctcctttttgatctgtacctgaggcccgaggcgggcccagaggcagtcttccagtacctggaggagaatgctaataaaatcctgctcatctttgatgggctggacgaggtcctccaccccggctccagcaaggaggctgcagatcctgaggcctcggcgtcagccctcaccctcttctcccgcctctgccatgggaccctcctgcccggctgctgggtcatgaccacctcccgtccagggaagctgcccgcctgcctgcccacagaggtggtcacggtcagcatgtggggctttgacggaccacgggtggaggagtacgtgagccgcttcttcagcgaccagccagtccaggaggcggccctcgcggagctgcgggccagctggcatctctggagcatgtgtgtggtgcccgcgctgtgccaggtcgcctgcctctgcctccaccatctgctcccaggccgctctccaggccagtctgcagccctcctgcccaccgtgacccagagctacgtgcagatggtgctttccctcagcccccaagggttcctgcctgccgagtccctgatgggcctcggggaggtggccctgtggggcctggagacggggaaggttgtcttcactgcaggagacatccctccacccacgatggccttcgcggcggccctcggcctgctcacctccttctgtgtgtacacggaacccgggcaccaggagacaggctacgtcttcacccacctcagcctgcagcagtttttggctgccctgcacctgatggccagccccaaggtggacagagacacacttgcccaacatgtcaccctcaattctcgctgggtgctgcggaccaaagctaggctgggcctcttagaccaccaccttcccacctttctggccggcctggcctcctgcgcctgccaccccttcctcacacccctggcacagcaggaggaggtgtgggtgcgtgccaggcaggcggcagtcatgcaagccttggagaagttggccactcgcaagctgacggggccaaagctgatagagctatgtcactgcgtggctgagacacagaagccggagctggccagcctcgtggcccagagcctcccccatcacctctccttccgcaactttctgctgacctatgccgacctggctgccctgaccaacatcctcgggcacagggatgcccccatccacctggattttgagggctgccccttggagccacactgtcctgaagccctggcaggctgcgagcaggtggagaatctcagctttaagagcaggaagtgtggggatgcctttgctgaagccctctccaggagtttgccaacaatggggagcctgaagaagctggggttgtcaggaagtaggatcactgcccgaggcatcagccacctggtgcgggctttgcccctctgtccacagctggaagaggtcagctttcaggacaaccagctcaaggacggggaggtcctgaacatcgtggaaatacttccccacctgccgcagctccggatgcttgacctgagccgcaacagtgtctccgtgtcaactctcctctccttgacaaaggtggcagtcacgtaccctaccattaggaagctgcaggtcagggagacagacctcgtcttccttctctccccacctacagagatgaccacagagctacaaagagacccagacctacaggaaaatgccagccagaggaaagaggctcagaggagaagcctggagctcaggctccagaagtgtcagctcagtgtctatgatgtgaagctgctcctcgcccagctccggatgggtccacagctggatgaagtggacctctcagggaaccagctggaagatgaaggctgtcaactggtggcagaggctgcgccccagctgcacattgccaggaagctggacctcagcgacaatgggctttctgtggctgggatgcaacgtgtgctgagtgcagtgagaacctgccggaccctggcagagctacacatcagtctgctgcacaaaaccgtggtgctcatgtttgccccagaaccagaggagcaggaggggatccagaagaggctgacacattgtggcctgcaagcccagcaccttgagcagctctgcaaagcgctgggaggaagttgccacctcaagtacctcgatttatcaggcaatgctctgggggacgaaggtgtggccctgctggctcagctgctccccgggcttggtgccctgcagctgctgaacctcagtgagaacggtttgtccctggatgctgtgttcagtttgacccagtgcttctctacagtgcggtggcttcagcgcttggacttcagctctgagagccagcacgtcatcctgagcggtgacagcagaggcaggcatctcttggctggcggatctttgccagagtttcaagctggagcccagttcttggggttccgtcagcgccgcatccccaggagcttctgcctcaaggagtgtcagctggagcccccgagcctctcccgcctctgtgagactctggagaagtgcccggggcctctggaagtcgaattgttctgcaaggtcctgagtgaccagagcctggagaccctgctgcatcaccttccccggctcccccaactaagcctgctgcagctgagccagacgggactgtcccaaaggagccccctcctgctggccgacctcttcagcctgtacccacgggttcagaaggtggatctcaggtccctccatcacatgactctgcacttcaggtttagcgaggagcaggaaggcggatgctgtggcaggttcacaggctgtggcctcagccaggagcacatggagccgctgtgttggtcgctgagcaagtgtgaggacctcagccaactggacctctccgccaacctgctgggtgatgacgggctcaggtccctcctggaatgtctccctcaggtgcccatctccggttcgcttgatctgagtcacaacggcatctctcaggaaagtgccctccgcctggtggaaacccttccctcctgcccacgtgtccgggaggcctcggtgaacccgggctccaagcagaccttctggattcacttctcccgaaaggaggaggctaggaagacactaaggctgagtgagtgcagcttcaggccagagcacgtgcccagactggccaccggcctgagccaggccctgcagctgacagagctcacgttgaaccagggctgcctgggcctggagcagctgactatcctcctgggcctgctgaagtggccggcggggctgctgactctcagggtagaggagccgtgggtgggcagagccggagtgctcaccctgctggaagtccgtgcccacgcctcaggcaacgtcactgaaataagcatctctgagacccaggagcagctctgtatgcagctggaatttccccatcaggagaacccagaagccgtggccctcaggttggctcattgtgatctcgggacccaccacagcctccttgtcagggagctaatggagacatgcgccaggctgcggcagctcagcttgtcccaggtgaagctctgcaaggccagctctctgctgctgcaaagcctcctgctgtccctctctgagctgaagaacttccggctgacctccagctgtgtgagctctgatgggctagcccacctgacatttggtctgagccattgtcaccacctggaggagctggacttgtctaacaatcaatttggcaaggaggacaccaaggtgctgatgggagcccttgagggcaaatgctggctgaagaggcttgacctcagccacttgcctctgagcagctccaccctggccgcgctcattcaaggactgagccacatgagcctcctgcagagcctccgtctaagcaggagcggcgttgatgacatcggctgctgccacctctccgaggcgctcagagctgccaccagcttggtggagctgggcttgagccacaaccagatcggagacgccggtgcccagcacttagctgccatcctgccagggctgcctgagctcaggaagatagacctctcagccaatggcatcggcccggcagggggagtgcggttggcggagtccctcaccctttgcgagcacctggaggagctgatgcttgactacaatgctctgggagatctcacagccctggggctggcccgagggttgcctcagcacctgagggtcctgcacctgcggtccagccacctgggcccagagggggcgctgagcctgggccaggcactggatggatgcccatacgtggaagagatcaacttggccgagaacagcctggctggagggatcccacatttctgtcaggggctcccgatgctccggcagatagacctgatgtcatgtgagattgacaaccagactgccaagcccctcgccgccagcttcgtgctctgcccagccctggaagaaatcatgctgtcctggaatctgctcggtgacgaggcagctgctgagctggcccaggtcctgccgcggatgggccgactgaagagagtggacctggagaagaatcggatcacagctcacggagcctggctcctggctgaagggctggctcagggctctggcatccaagtcattcgcctgtggaataaccccatcccccaggacacggcccagcatctgcagagccgggagcccaggctggactttgctttcttcgaccatcagccacaggtcccctgggatgcttgacggcccccgcaagacccttccaatacagccaagtgatgtccgcttccatcccccaggatagagggctcaggaaaagagcctcagctggctgtcccggcacactgttccgggagggagagacgccgttttccaggcacggtcttcagaatggactttatgggcgacaaagagcctaccatggccaacagaccaccctccatcacacatgacatgcatgaccagtcgggaatatgcagcacagtgaggatgtcgtggcgtgatgcaagacacagaaggttgcacgtggcagcgttccatgtgacattgcatgaaacctgcagtgtggcctgtgggttgttggcgtgggtcctagcactacatgtgatgggcagtccatatttgagacgtggcaaatgtccgtgtcatatgccatgtggctggccagatgccctcatgctggtccaagatttaatttattaattttttaaacaaagtatgtatttatagattacctttccagagcagctaaaccagggaatgtcttccaaacaagtgcgatgaggaaagcatacaagcactgatcagcccagtggcctgaggtccagggccctgggccaagccagggatttagccacgaggcttgtggatgactatcctctcgcctcaagcctcagttttcccaatctgggaactggctcacccctcccgtagcttcccaggtcttagagcccaggtccaggtagcgttagcctgaccttggggatcacaggcctgggctgtcctgtgtaagggacaaagccagatctaaggatgcagcgggtggggactgccaagttaggcaaggccgctggacccggccactacctcagtggatctgactgaactcccgggagctcacagtgttcatgttgtttccaagaaggcccaaggattgtgagccaagtttgatcaataaatgtgagtgatcttccggcctctaaaaaaaaaaaaaaaaaa

SEQ ID NO: 7 - protein, 1846 aa, Sus scrofa
MDPISRHLGTKNLWGWLVRLLCKHSEWLSAKVKFFLPNMDLGARNEASDPTQRVVLQLRKLRTQSQITWQAFIHCVCMELDVPLDLEVLLLSTWGHGEGLPSQLEADEEHPPESQPHSGLKRPHQSCGPSPRPKQCRKQQRELAKRYLQLLRTFAQQRYDSRSPGPGQPVACHRTYIPPILQWNRASVPFDTQEGTVAGGPKAEDGTDVSIRDLFSAKANKGPRVTVLLGKAGMGKTTLAHRLCQEWADGQLERFQALFLFEFRQLNLITNFLMLPQLLFDLYLRPEAGPEAVFQYLEENANKILLIFDGLDEVLHPGSSKEAADPEASASALTLFSRLCHGTLLPGCWVMTTSRPGKLPACLPTEVVTVSMWGFDGPRVEEYVSRFFSDQPVQEAALAELRASWHLWSMCVVPALCQVACLCLHHLLPGRSPGQSAALLPTVTQSYVQMVLSLSPQGFLPAESLMGLGEVALWGLETGKVVFTAGDIPPPTMAFAAALGLLTSFCVYTEPGHQETGYVFTHLSLQQFLAALHLMASPKVDRDTLAQHVTLNSRWVLRTKARLGLLDHHLPTFLAGLASCACHPFLTPLAQQEEVWVRARQAAVMQALEKLATRKLTGPKLIELCHCVAETQKPELASLVAQSLPHHLSFRNFLLTYADLAALTNILGHRDAPIHLDFEGCPLEPHCPEALAGCEQVENLSFKSRKCGDAFAEALSRSLPTMGSLKKLGLSGSRITARGISHLVRALPLCPQLEEVSFQDNQLKDGEVLNIVEILPHLPQLRMLDLSRNSVSVSTLLSLTKVAVTYPTIRKLQVRETDLVFLLSPPTEMTTELQRDPDLQENASQRKEAQRRSLELRLQKCQLSVYDVKLLLAQLRMGPQLDEVDLSGNQLEDEGCQLVAEAAPQLHIARKLDLSDNGLSVAGMQRVLSAVRTCRTLAELHISLLHKTVVLMFAPEPEEQEGIQKRLTHCGLQAQHLEQLCKALGGSCHLKYLDLSGNALGDEGVALLAQLLPGLGALQLLNLSENGLSLDAVFSLTQCFSTVRWLQRLDFSSESQHVILSGDSRGRHLLAGGSLPEFQAGAQFLGFRQRRIPRSFCLKECQLEPPSLSRLCETLEKCPGPLEVELFCKVLSDQSLETLLHHLPRLPQLSLLQLSQTGLSQRSPLLLADLFSLYPRVQKVDLRSLHHMTLHFRFSEEQEGGCCGRFTGCGLSQEHMEPLCWSLSKCEDLSQLDLSANLLGDDGLRSLLECLPQVPISGSLDLSHNGISQESALRLVETLPSCPRVREASVNPGSKQTFWIHFSRKEEARKTLRLSECSFRPEHVPRLATGLSQALQLTELTLNQGCLGLEQLTILLGLLKWPAGLLTLRVEEPWVGRAGVLTLLEVRAHASGNVTEISISETQEQLCMQLEFPHQENPEAVALRLAHCDLGTHHSLLVRELMETCARLRQLSLSQVKLCKASSLLLQSLLLSLSELKNFRLTSSCVSSDGLAHLTFGLSHCHHLEELDLSNNQFGKEDTKVLMGALEGKCWLKRLDLSHLPLSSSTLAALIQGLSHMSLLQSLRLSRSGVDDIGCCHLSEALRAATSLVELGLSHNQIGDAGAQHLAAILPGLPELRKIDLSANGIGPAGGVRLAESLTLCEHLEELMLDYNALGDLTALGLARGLPQHLRVLHLRSSHLGPEGALSLGQALDGCPYVEEINLAENSLAGGIPHFCQGLPMLRQIDLMSCEIDNQTAKPLAASFVLCPALEEIMLSWNLLGDEAAAELAQVLPRMGRLKRVDLEKNRITAHGAWLLAEGLAQGSGIQVIRLWNNPIPQDTAQHLQSREPRLDFAFFDHQPQVPWDA

SEQ ID NO: 8 - DNA, 8621 bp, Sus scrofa
gtctgagaagagcttcactcaggagcatctgacccaccaggagcctgcaacatggtccaatagcgccccttattagccatgagctgctggtgggttccctcctcaacaatggtgcctccttccagaaagaggatgtgattggcctgctccacggaactaagacgctgggtgatgagaagcacagaccgggagtaccgctcagggctttcatacaggagcgactccacctgagaaaaaaacacagactctgtcagagctgggggccactcccggaagagctgggacagacctcgccaggatcactgccacttctgccaggaaccccaaaatcaaagcttctcattctgagtgcttctctgtcaaacttttgatctgttaaggacggtttacatgagggggcaagagcgtgtcctatggtgaaactcataagtatgaagggtattgagtagcctctcctctctaatttttatattctctttcaaggagacataagtgagtagtaaagagaatgaatattcgagtcaggcagactcgaatttgggtccaggctctgctattcaacattgagctgaatgctatcgagtgcgttgttcagcctctcttagcctgcattttagcatctgttcgatgaagataacaacagccagctcacaagcattcacgatgaataattaaatgagagagtacatggaaagggcctgttaacatttctggcacatggtaagatttcaactaatattggtatgatgggatcttttcttttgtttggcttcacagattcagagtctgaggatcgtctcttttaactgactctaggcatgttggggagaagcgaaggggaactgagaattgcaaagactggtttggatgattatgatgttagtacaataacaaaggatgagtgaaggaaggaggactgggtgggttacaggcattaagaagatgactctctcacccgtgcttgactgtttgcatccagggcactggtagcatcatccaggatgagtacccgtggtttccggatcaaggctcgagccaaggccactgcctgccgctgaccccctgatagctggctcccagcctcacctacctctgcagagacaagtgcccaggtaagagctggataaacacatgtgcatccatgtgcttgcatgcacgcgcgagcgtgtgtgcacatgtgcacgcacgcacgcgcgtgcacacacacacacacacacacacacacacactcggactaacagatacagctggatagggaaggttctgggaaggtgaaggagttctgaggatatgaggatgaaagagccatagaaacaagctcttacaacttcatactgatgaataaaggcaagactattggatttcaacaaaggtaaagatgtctgagccataaaataaaatttaaaaaaaaaaagagttcctgctgtggcacagtgggttaaggatgcaactgcaggagttcctgacatgactcagtggtttatgaacccaactagtatccacgtggactcgggttagatccctggccttgctcagtgggttaaggatccagcattgccatgagctgtggtgtaggtcagcagctgtagctccgattcgacccctagcctgggaatgtccatatgctgtggtgcagctccaaaaaaaagcaaaaaaaaacaaaacaaaacaaaacccgaatgctgtggctcaggtcgccttggaggtgcagttcaatccctggcctggtgcagtgggttaaaggatctggcgttgctgcagctgctgcataggttgcatccgaggcttggattcagactatgggtgtggccataaaaaactagcccccccaaaaaagatgcctgggtggtgatatgagaggagagagcacctgtgtcgtagccttgcgggagcttggagatgaagctatgggctccggactccacggcggcagctatgacttcctccattgctggcttctggctcaggccataggcaatgttttcttgaaaacttcttccaaagagctgtggctcttgccccaccgcagccacctgggacaaagcatgatgagagaacgaggaacacaggagtatgatgatctggagactgaagactgaaaatctttattgtgaacaaatcatgaaatcacacagcctctctcctgaacacaccccccgcccccccaggatctcctgtcattcccagcactcctttcagagtgcccagtgagcatggtcttcttactcgcagctccctgccctcccctgtgccaccttcttgctcacctgtctgtgcaggtagcggtgctcatattcaggaaggggcttctcacccagcagcacctgcccctccgtgggctggtacaggttctgcagcagggcagccacggtgctcttcccagacccattgggccccacgagggcggtcacctcaccaggacgtagagtgaacgtgaggccctggaggccagagaatcacacactaagaggcagatcaaggcccctaaccttaagagcgtcatggacttggcccattgttttgtcagtgtctcaccccagagaagaaaagaggaaagtggagaaacacagcaactcctaccctcccacatgcacagacttctgctcctcagcgatgccacctccccgtggactagagatggaagaagagacaaagaccagggcaaagaccatgccgcacactcaatctcagagaccaggagaaaaaaagaaaaaaaaaatcacatttgaaatcacaaatggaaagaaaaaggaggagttcctgttgtggctcaggaggttaagaccctgacatagtgtccgtgaggatacaggttcaatccttggcttcgcccagtgggttaaggatctggtgtggctgcagctgccccgttcagtcacagaagtggctcagagccggtgttgctgtggctgtgatgcaggcgttcagctcctggcccagtgtgaccattaaaaaaaggaagaaaaaaggcaagaaaaaggaaagatggaagaccagatggatacacagattttgcagcagttccttaggatatgacagccttctccctgaaagcctcctttcctgtcctccctggaaatccaaactaggtcttgagtttggggcaattttatggaacagatgatgctcatctttgcctctgaagggtaaagaaggatctagctacacctgatgttaagcagactgaaggcaggaagacgattcagatcgagctgagaggaagattggtggagtgcaggggttggtgggttgtacctgcagcactgggacctctggtcggttcgggtaggcaaaggagacattctggaacttgacaagcccctctgactttaaggaagtcaacgatccactggccgggcagcgagggattcggtccagatactcaaatatttcctttgaggagcccacagccttctgtaccctggggtaggtggacagcagtacctggaggggaggtatgaatagtgagatgggaggaggtagtgggggagggacctaatctgcctgccaggattatgtgatgtgagaagggcaaagcatggaaggaaggtgactcagatggtgatgggacaggggagggaaaagccctgggatgtgagaatggaaggacctcacctgaacagcttcggtgaactggatctggtagagaacaaatgtgacgaggtttccgctgcttatagccccacctgccaccagcttcccgccaacatacaggattcccaccttcagcaacatccctgagatctgtggagagaccacacagaaaagggacttttgtagaaaaatctagaggggctgcagagaagcagaatcattagcattaaggagataagaagttcttggagttcccgtcgtggctcagtggttaacgaatccaactaggaaccaggaggttgcgggttcgatctctggcctcgctcagtgggttaaggatcgggtgttgccatgagctgtggtgtaggtcaaagatgtggctcggatctagtgttgctgtggctgtagctctagggtaggctggcagccgtagctccgactggaccccttgccagggaaactccaaatgcctcaggtacagccctaaaaagcaaaaacaaacaaataaacaaaaaaaaggaatgaaccatagcaatgccacggagtctcactcagttatacagaaaagaagccaatcgttattaccatcaccattatcaccttgtctgggaagcatttactctgcacaaaaggctttcatgaatgtaatgtcatctaatagtcgcatcaaaagccccataaacaaggttaggtcactgccatttttaaaactgagaaaacagtctcagagaagtgaagtcaccagcccctggtcacagagccggaaaatggcagcatcgtgataggaacttgatggctggtcgtgttcgctttcggttacatcacaggtgcccctcatccttgcttctgctactcccaggactctcactagcatccatgtagtgtcagcatgaaacgggacagggtgccagaatttatagtcctctgagcacccccttgaggcaaaagaaggccttggaaaacacttccctaaagagagggttgggtggatttttgtgtaccgtagtgaaaggaagccatctagcacgcctaaaaaggggggagggggttaggaacagtgagtagggtgactgagcctccggttgttagaatatggccactgaaccaaccactgggcagtggaggaagagtgtggagcagggtcatgggaaagggaatggcattgaggcatcttggggacaagggactaggcagtcatctgcaggtgctcacactggtggtccagaggtcgaccgcataggccagggcctccttctggttgagtgtcttcatgtcctgcagcttttgcttgaacttctgggcctcaccctcttcattggcaaagctccggacagtaggcatagctgacagaacctcaatggccacctggcttgactttgccagagattcctgcacctgtgctgccagcacctgtggagacgtggaccagagatgccacacatgattgttgacaaaccataggggacactagtacctgagttatccgattagagtttaaaggtgagacgtggcagagggaaggcaaggggacaaagggacacagccaggcccccagatactaaaggatacagagaagaggaaaatgacttagaagcgtcgtaggggagcatattcttgagatgggtgatcatgttcttaaagacagattgtgggcaggcattagaagagaagacacaagggatgtgaagatcaacactgagcaatctgggaacatggacgacagggacaaggagtcccacaaagaggagaaccagtgaaggtgccaggaaagggatctgagcccaccaagtctgggatgagggtcagtgtaggttgaggcaactccctagacatacctggtgccatttccccagcttctcaggcagaaggaaaagcagtggcaaggcggccagggtgaccatggtgaggggaggtgacccccagagcatgagccctaagagacacagtccccgtgcgaggtaccacagcaagaggctcagctccgaactcagagacacactcacagtggatgtgtcctctgttacccgagatgtgatggcacctgccaagggttcaagagaagagagtggagtgaacaggaggctcagagtgatgggagcgacgagcaatgagccaggtgccacagcgaagggcatcaacacagtgttctaagaaggtcaggaaaaggagttcccgtcgcggcgcagtggttaacgaatccgactaggaaccatgaggttgcgggttcgatccctgcccttgctcagtgggttaacgatccggcgttgctgtgagctgtgatgtaggttgcagacttggctcggatccgcgttgctgtggctctggcgtaggccggtggctacagctccaattcgacccctagcctgggaacctccatatgccgcgggagcggcccaagaaatagcggggaaaaaaaaaaaaaaaaagacaaagaaggtcaggaaaacaaggtctgtggttgggggaggactgaaacataatgcaagaaaaatgtgttagagtggaaaagcctggccaaagaccttcgttttaactataaagaaattgatgcccagagttcccactgtggctcagcggttaaggacctgacgccgtctctgtgaggttgcaggctggaaccctggcttcgctcagtgggttaaggaccagctgttgccacaagctgtggcgtaggtcacagatgctggatcaggtgttgccatgactggcacaggcctcacctgtagctctgattcaacccctggcccaggaacttccatatgccacaggtgcagtcataaaagaaaaaaaaatttttaaagaaatggatgcccatgtgaacttctgtttctctgacaggtgtctgttccttaaagaacttgtatataccatgctcataggtaggaagaacttaagctggtcatacaagagctggagaaaaatggagagactactagagagcagtccaggaaaccacagcaagcactggattgggaatcaagacatgggttctgctctcaagtttgtcttcatccatgtgcatccatgcaaatgttggcatttaggtctagacctcatttcacttctctgtaaaatgagtcagctagactctctaatctcaaaatttccaggtttgaaattctacctaaatacacttatagggatagtttatggaaaaatcttgggtggaaacagtaggttaatcatttttttttttgttttattgtgtttttggttttgtcttttttttttttttttttttttttttttttgcccttcccacagcatgcagaatttccctggccagatggaacctcgccatagaagcaaactgagtcacagcagcgatctgagccacagcagccacagaactacagcagtggcaacaccagatccttaacccgctgagccaccggcgaactccaacagtaggcttttctaaaggtaaagagcatatcttgctcttgaagtacatcaagaataaaaagggacaccatttgtgtgtgtgtgagagaaagatcaagattataagtaaaagatgaagtgtggggatacaaatagaaaacagacggataatgaaagaggttcataagacacctgtttgattcttctgaaaaaactctgtttcttggcgcaggacagaccgaaacacctctccctgcaggtggctgtgcacgcggcccatggtgctgttatagatcccgtcgcacacgaactccagcaccgagctagagggagacaaagaaggagggccggtcggtcagggaccccgtagaagtgcactttggagggcggccccaacttccaactgcgcccttttcagggtcccccgtccccagccttccaagctcagcagtcagacctggctatgatgaggatggacatgagagttaggttctgcgtgaaggcagcacctgccccatctcgtagaatccagtcagtgagccggcctgtgaagaacggaatggccatctcccctggggagggagaggagagatgggcgggtcagaaagagcaagtctaagcagcctaagcagctcagctctaaccaggctgcacctcccgcccatcctcccttcacccttgcccattatcctgcagaaacagcgcacactctcggcactggaatgggcccccggggaactcgtaatcctgtggcctcaccagacctttagagggttaattaagaagcctaggatggtaggaggaaagagctcgcccaaggtggccagtgaagcaacacctgagcagcactggagtccaggactcctgactcccacccagtccagggctctttcctctccaccaagtggacctgagcggggtgggcttgctcttatccacatttccgagaactcacacctgtctatctcactgaccgttaggcttgattcctacccagccctctagcctccctctccctccccccgcatcccccttaccaaggctggagaggaccaccagggtcagaaggagccagaggtggcggatctctgagcccaggcagccgagaagccggctcactgtcactccagagcctctgtgacttccttgcacccaaaggctgctaagcttatgccacagggcggccgcgggcaatgccgccgcatagctgagggcgaaggcatcgaggcgactcccccagtgcagtagccgcgtgctgtcagccgctcccgagcccaactctcggaacaaggcaagtcccggcagagccaagcccagagccgccgccagcggctccaaagctgccagccatccccgaagtcctgtgcttttctcccggaagccaaccgtcgccctgaggacgctgcgggcccccaaccacagcacagcccaacggctcaggcccaccacccagacccggagcagcggcagcgctgggggcagcagcagggaggatatccggggcagcgccggccggagcagcacccagtcggcgagaagcagcagcgctgcccccagccaagggagggaagctcgggagacgcagagacacccgcagggagcggaggaccccgagctggccattggccgtacgaggtcgaccc

SEQ ID NO: 9 - DNA, 2280 bp, Sus scrofa
gcccttgggtcgacctcgtacgccaatggccagctcggggtcctccgctccctgcgggtgtctctgcgtctcccgagcttccctcccttggctgggggcagcgctgctgcttctcgccgactgggtgctgctccggccggcgctgccccggatatcctccctgctgctgcccccagcgctgccgctgctccgggtctgggtggtgggcctgagccgttgggctgtgctgtggttgggggcccgcagcgtcctcagggcgacggttggcttccgggagaaaagcacaggacttcggggatggctggcagctttggagccgctggcggcggctctgggcttggctctgccgggacttgccttgttccgagagttgggctcgggagcggctgacagcacgcggctactgcactgggggagtcgcctcgatgccttcgccctcagctatgcagcggcattgcccgcggccgccctgtggcataagcttagcagcctttgggtgcaaggaagtcacagaggctctggagtgacagtgagccggcttctcggctgcctgggctcagagatccgccacctctggctccttctgaccctggtggtcctctccagccttggggagatggccattccgttcttcacaggccggctcactgactggattctacgagatggggcaggtgctgccttcacgcagaacctaactctcatgtccatcctcatcatagccagctcggtgctggagttcgtgtgcgacggaatctataacagcaccatgggccgcgtgcacagccacctgcagggagaggtgtttcggtctgtcctgcgccaagaaacagagttttttcagaagaatcaaacaggtaccatcacatctcgggtaacagaggacacatccactgtgagtgtgtctctgagttcggagctgagcctcttgctgtggtacctcgcacggggactgtgtctcttagggctcatgctctgggggtcacctcccctcaccatggtcaccctggccgccttgccactgcttttccttctgcctgagaagctggggaaatggcaccaggtgctggcagcacaggtgcaggaatctctggcaaagtcaagccaggtggccattgaggttctgtcagctatgcctactgtccggagctttgccaatgaagagggtgaggcccagaaattcaagcaaaagctgcaggacatgaagacactcaaccagaaggaggccctggcctatgcggtcgacctctggaccaccagtatctcagggatgttgctgaaggtgggaatcctgtatgttggcgggaagctggtggcaggtggggctataagcagcggaaacctcgtcacatttgttctctaccagatccagttcaccgaagctgttcaggtactgctgtccacctaccccagggtacagaaggctgtgggctcctcaaaggaaatatttgagtatctggaccgaatccctcgctgcccggccagtggatcgttgacttccttaaagtcagaggggcttgtcaagttccagaatgtctcctttgcctacccgaaccgaccagaggtcccagtgctgcagggcctcacgttcactctacgtcctggtgaggtgaccgccctcgtggggcccaatgggtctgggaagagcaccgtggctgccctgctgcagaacctgtaccagcccacggaggggcaggtgctgctgggtgagaagccccttcctgaatatgagcaccgctacctgcacagacaggtggctgcggtggggcaagagccacagctctttggaagaagttttcaagaaaacattgcctatggcctgagccagaagccagcaatggaggaagtcatagctgccgccatggagtccggagcccatagcttcatctccaagctcccgcaaggctacgacacagaggtaggtgaggctgggagccagctatcagggggtcagcgacaggcagtggccttggctcgagccttgatccggaaaccacgggtactcatcctggatgatgctaccagtgccctggatgcaaacagtcaagcacgggtggagtcgctcctgtatgaaagccctgagcggtactcccggtctgtgcttctcatcacccagcgtcttagttccgtggagcaggccaatcacatcctctttctggaaggaggcaccattgttgaggagggaacccaccagcagctcatggctaataaggggcgctattggaccatgttgcaggctcctggtgggtcagatgctcctgagtgaagctcttctcagac

SEQ ID NO: 10 - protein, 746 aa, Sus scrofa
MASSGSSAPCGCLCVSRASLPWLGAALLLLADWVLLRPALPRISSLLLPPALPLLRVWVVGLSRWAVLWLGARSVLRATVGFREKSTGLRGWLAALEPLAAALGLALPGLALFRELGSGAADSTRLLHWGSRLDAFALSYAAALPAAALWHKLSSLWVQGSHRGSGVTVSRLLGCLGSEIRHLWLLLTLVVLSSLGEMAIPFFTGRLTDWILRDGAGAAFTQNLTLMSILIIASSVLEFVCDGIYNSTMGRVHSHLQGEVFRSVLRQETEFFQKNQTGTITSRVTEDTSTVSVSLSSELSLLLWYLARGLCLLGLMLWGSPPLTMVTLAALPLLFLLPEKLGKWHQVLAAQVQESLAKSSQVAIEVLSAMPTVRSFANEEGEAQKFKQKLQDMKTLNQKEALAYAVDLWTTSISGMLLKVGILYVGGKLVAGGAISSGNLVTFVLYQIQFTEAVQVLLSTYPRVQKAVGSSKEIFEYLDRIPRCPASGSLTSLKSEGLVKFQNVSFAYPNRPEVPVLQGLTFTLRPGEVTALVGPNGSGKSTVAALLQNLYQPTEGQVLLGEKPLPEYEHRYLHRQVAAVGQEPQLFGRSFQENIAYGLSQKPAMEEVIAAAMESGAHSFISKLPQGYDTEVGEAGSQLSGGQRQAVALARALIRKPRVLILDDATSALDANSQARVESLLYESPERYSRSVLLITQRLSSVEQANHILFLEGGTIVEEGTHQQLMANKGRYWTMLQAPGGSDAPE

SEQ ID NO: 11 - DNA, 75569 bp, Sus scrofa
  modified_base (6835)..(6934): a, c, t, g, unknown or other
  modified_base (57902)..(58001): a, c, t, g, unknown or other
actgagaaaataatttatttaattttaaatcaggaatttttattttttaatattgaactattaataagatcttgaatttgtccatttgaaatttaaatttaaatgatttttttttaaaaaatcaagattccttcaaaaggaaatatcagtccttttctttaatctttgagaacgaatcatttctgtagtttggaacttgcaccatgaagtctctgcactccagaatggattccataaacttgcgttatagagaaacaagagtcctaattgacttgtgatttcctttttcttttacaagactacttctccaggatttttgttgagttattttgttgggttattttgttgagttattttgctgggttgcaaaaatttttagcaagaattgaagagtaggaggcccagggaaacagtagagaaaatgtaggtttcattttatcaaagaagcccatcgtgctgaacatcaagtcagtgcaatggctcttcaagtaaatcatttgaaaatggacacaaatgacctaaactggaacacaagcaaaagtatatcacatacctgcagatgtaaatattgcctcctaacttcctttacaccaaactgcttaactttaaattacatgtaagatctcatagcttttcttagagaaagggattgaaaagctgtttagtcatgaggactgggtctcccattgccatcctctctactttgatataaaatcaattaaccactttattaaacatgtccggcagttacacttcagtagtgcagctggggcaggggaaatgagaggttccctgataagcaggcttttcctctagtccactccttgacggtggctctcaagttgcccatgatgggctgagggactctgagagttagagcaggtggcagcaggacttgctgatgcctgattgtcatgaagccaagatctaggaagtcacttcaacccactgtaggcctctgtccactctgacatcatccacttcctctgagcaaggatttgtagacacaaattccagagtctggcagactgaatatgacttggccaaagcaagaagcatcttctaagacagtgctgctctagttgtcatatggttgaggaggctggagccactctcattgcctcccattcagtgcctggatccaagctgtatgtacatgccaactccatgccctgtgtctcttagaaatggcattgccccacagtgatcagccccctctctttccaatctgtcttcgctatttcatggcaaacttacttagaagctgtgcttttatttcgtgctgagctcccattggttcattcggattccctgtaactcccaacattcaccattgggaatcttgatcagtatctgcgcagaagccaaacaaaaccctgatgcgaaaaggacatggacttcaaataacctgaagtcctctgctgttgaaatcatctgaggattgctaaggtagactctgatctcctgctgcaaagcaactctgttgctttagacttagcagagacaggaagacgctaaaatcaagaggacgacccctcccaatcttattttgttgccaaacacttccctttgcatacttttctccagtatgacatgtagagtgtctctgactttttctttgcctatgacaatttttttttttggttcagttaatagtatataccccctcaacccagaacagataagaaatcattgggaatttacatctgattactacagagtcattctcccatttgacaaggctcaaagttgcaaggaagaataatatgtacttactgtgttggtattttgttagtatttttttaaaagttaaaattaagtgctacttctctgaggaagtagccagagtaatactctttcaaattcagaaaactgctggcacaatttaaagtcagatgttatttctaaccaaattatactcttttttctgccaagctatcttgacaatcctaatatccacagacatgcctatatgataatcccagcagtattctggggataagattttagtgggtttgttgagaaggaaatacttgtttagatggctttcatcatgccactcggcttctatgtcattttccttgtcctggaggattcccttgaagcactcctgagtgatgtttagaacctgagtgggtgttcccccaaaaatggctgcgtggtaataaaaatccccctggccaaacggaatgtaggctgcggactccttccgcctctcgtaggtgaactcgtcaggatgtgccttgtaccaccaggcctgtagctgagccaccgactggcccagggtctccaccccaaagttgttttggaagacctgatccacgtccatgcagaagaggaagtccacctcgtgctggatgtgggccaggatgtgctccccgatggtcttcatgcgcatcatgctgatgtcttgccacctcttctcggacttgatctcaaacactttaaaggaacgcagaggacccagctctatcaaaggcatcctggagatatcatccaccatgatgtaaaagatgactttgtggccaaccatgaagtatgtatttgcagatattaagaactcctccaagtaatgctcaatgtatctgaaataaagaagaatggggtaaatgtaacctctgggatttctagaggagacaatatgctattatcatctagtctgtattttgcagtttaggaaaggaatgatttttccccatcctggatgagagacgtctgttgctgtaacattcccagctactctccaccattcagtcattcagctttggggaggtggagtggcttacctgactggtgattctggcagggtggctgggcatgctcagccctgctccttcctctctcactcttggaagccaaccaggcagagagaacatgtgttttcagctgctctgggccttgcagtggtaccttagtggcacaggccctgctcccacatccagaggcctgcagttacttgtgctgtatgtgcctggatgcctaagtctttctaattctgtggttcaagatttggaagcccagggcctgcagttataagccacatactccaacaccagctttaactgtaatgaaggtgataactcattaccatctgccttaattagtctttatccccttgtccttatcaatcagttcagatgctagttcttccttttttcctgcattattcagatataactgacatatatcattgtgtaagtttaaggtgtgcaaagtgttgatgtgatgcacttatttttaatttttattttttgtctttttagggccacatccgcagcatatggaggttcccagactaggggtctaattgcagttgcagctgctggcccatgccacagccacagcaacaccagatctgagctttgtctatgacctacaccgcagctggtggcaatgcttgatcctttaacccactgagcaaggccagggatcgaacccaaatcctcatggttactagtcagattcttaacccactgagtgacaacggaaactccctggtacactcatatattagaaatgattaccactgtggcattacttgacaccttcatcatatcacataattaccatttttttgtggcaagaagacttaggacttattctctgaccaaccttaaagtatatattacagtatgattaaaaacaatcaccatgctgtacattagatcccagagcttattcatcttataactgcaagtttgtaccctttgattaccatcagggggcactagttcttagctcttcctcaaaaaccccagcctatattccaatacttttactgacctaccagatgcaagcgtgatgtgcaagggtcattaagcctaaccatcgccactctcttatccttctctgggacccaaacaatggattatggaatatggatattcttccatcttactgatttaccctgtgagtttcccgctggtcaccccaaacaccagcccattatccagacaccatcattataaaacccatccaaatatgagagcaaacgacctctgattcaaccttactttaactatctcgtttcatttaaaaaaatagattttagtttttagaacatgtttaggctcacagcaaaattgagctgaaagtgcagaattccccccgctccccccactcccactcccagcttctcccaccatcaacatccagcaccagggtagcacgtgttgcaactgatgaaactacactgacacatcattatcacaccaagcccgtagtttacactaaggttcactcttggtggcagactttctatgaatctgaacaaatgtaaaatgacatttatctatcactatgtatggtaccatacagagtattttcactgccctaaaaaatcctgtgttctgtctattcatccattctcccacaccatcgcctggcatctactgatatttttactgtctccatggatcagtacctttgaccttttccagaatgtcatatagttggaaccatatagtaggtagtctttgcagatggtttcttggtaacgaacatttgaggttcctccatgtcttttcatggattgatttttttttttaaagcactgctaatactccactgtctgaatgtgctacaatttatcaattaatttgcctactaaaggacctgttacttccaagttttgggcaattatgaataaaagtgctataaacggagttcctttcgtggctcagtggtcaacaaacccacctagttgcaggttcaatccctggcctcgctcagggggttaaggatccagtgtggccatgagctgtggtgtaggtcgcagatgtggctcagatctcgggttactgtggctgtggcataggccggcagctgtagctctgattcaacccttagcctgggaacctccatatgccgcaggtgtggcccaaaaaaaacaaaaaaagaaaaaaccaaaacccaccccccccaaaaaaaaatacctgctataaacatctgtatgcaagtttttgtgtagacataaagtttcagcttttgagggtaaatactaaggtgtgccatcgctggattgtatggtaagagtatgtttagttttgtaagaatctgccaaactgtcttacaaattggttgtatcatttcgcattgccagcagcagtgaataagctttcctatcgctctacattttcatcagcagctggtattgtcagtgtttgggatttgggtcattctaatagatgtgtagtggtattttagctatttacctattcattcaaaaaccatcatgttcaggaagaaaaggaaaggggggagttcccattgtggcagtggcacagtgggttaaagatccagtgttgctgcagctatggagaaggtcacagctgtggctcagaacttccatacgccacaggtgcagctgaaaaagaaaaagagaaaaaaaaaaacccatcacattcctgtcttctgtaagccaagatacaggctattctgtgaagccatggggatgatagagaagggaagaagtagttggctggcttaacacaacccacgtcaccacccagactcatgcccagtgactgtgcactgaatttaatttgttgatcacattatcagccaatgatgacattttgtaataatgactggcacttccttttgttttttggttgctgcttggattccctttgattactacaaacataaactgtgctttcaatgctggtctctggaaaccccaggtttatagtattgattctttaaacggagagaatatctcagcaatacaaggagggacttcaacatggctctggggctaatggccaggaaattcttctgcactctggaactttaagaaaaaatctattgtgccctgaagcttgggaggtgatcctaggggcgagggaggaaacctttgtgaggtttaacattgtttagagattaaagcgctgcagttggtgctgtgcactgtcatttgaaaataaaccaaacatcacacctcctaaaagtccaaatccactcttgggaggatttattgctgctgagtacaaacagtcctcactcgcctcagagcagagtgcgcgggtttcaccaggacatgccaagtacagtttagttctctaaagctgcaacaagatggctagagccaatgtggagccgttctttttggaaacaccaaggttaaatcaatctgcagtatggctggctggtctcctcttataccaaaggattaggtgagctgggaatctttcccaactcctaacagaacatattcttctagtcgaaaggtcaaaactccagagtcacccttctctattagagatgccacccaggcccctgggatcagtacattcagggacattaggacttgattagtacagtgacagtgataccttctgggctctaggttggagaaggtctcaggaggacgcttaaatcttcactcagatcaaccttgaccttcacttctctttgtacaggcaacaggtcaactaacttcttttcttttcttttcttttctttctttctttctttctttctttctttctttctttctttctttctttctttctttctttctttctttctttctttccttccttccttccttccttccttccttccttccttccttccttccttctttctttctttcttcctttctttctttctttcttcctttctttcttcctttcttcctttctccctttctctctttctctctttctctttctctttcccttccttccttttctttcttccttccttccttcctttcctgcttttttagggctgcaccctcccaggctaggggtccaatcgaagctgtgatgatggcctgcgtcagagccacagcaatgcgggattcgaaatgcatctgtgaccacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttcttctctttcggatttttttttaagtttggtgaaagtatagtgtcttacaatgttgtgataatttttctgtatacaaagtgatttcagtttctttgtggcttcagaaaaggtacagatggaaaggcccatggatgtgggggagggaaggggcacggaggtgaacaggaaaattgaacttttgcttttgttttggaaaaaaagggggggggattctctaaaaaagaaaactgggttatattttaaacgaacattacagctactacttttaagtaagaatgtttacagtttggggagaaaagttccaaacaaggaaacgggggctgaaacaggaacctatccaacctctggaagaggaagttctgagcagcctaatctccccgggccaaaccctccaggaggaataggcagaaggcacagaggagtggtcagccatgcggacgtggaaaaccactccacttaggacacttctgtctttggtccttggtctggggtctcgagagcataggagaaacgacgcacacacaggccatctaacaattgccatttttggaatttccacagagggccgtggaggtcagggcggaggtggctgtgggtgtactgtcgactctgggtgcagtgggtatagcagatcttcttccctgcaacccaagcccctcaccctgaggtgggaaagagttgaccctctgactagttttattcttagcctttggggacctcagcagaagggagtctaaaatggccctgtgacaccattctcctctccactaattcagacatgacatgaacagcctctgtaaacccaggggcccctcacccatcctctgatagtggaaggggaaaaactcaaggccagttttattagcaacacctaccttccgacagcaaaaaccgtcaagcccacggtaattttctgtttggcataataattatctaagacggctctgttgtaagtgccttcccataccactggagccttccatctggttatggtcacgacctctgggcgtttcctggtgacaaaacatagagtcaggatggctttgctaaggtacgacagtctgggggaacatgggtcagtcatggcttgtggtgactggccttgaatcctgactgtattttagccccagtcagctggtggtgtgacattgcagcatcttctgggggagggacaggaggctctggcccaggtgcctctgcgggctgccctggtggcccctttggggatcgtacctgtacaacgtgtatgtaccttccgtccccctgttctgctgtcctcgtcctcaatcttccttccaaaccccttcgcctatctccccaggcccttcctaagctgccagcgacatctttgggtgttgcttatcccagtgggtgccacctgaccctgagaaagccctatggcttgactagcgggatgagagagtgacatttgagctgaaagaggaagaagctgtctcagtttgccttctgccagaaagcaatttctgggtaggaacctggttatcggacaaaaagggccccagactaaggggacctggtgttgtggttcattttacgaagaaggagacagtcacccagaaaagaagggacccggcgggctaactgtggccatgggtgacacacagggctcgggctcagacctctctcagatcatgtcacctcttgactagaagcacaaaagcgggaggggagggggcatgttctctgcacccagaacacttgaaagggacttagcaaagccaacacaaacacaggaagccacggaagagcaacggacaaattgtaaagagtaaatgcgggaagtctgggtagcagctggggccccccagaggcaggagggagctgagaagacttggctcaaaccccatttgctctggaagtggctgcacttccccgtcggaaacagactgaaacgtggtcatttagattcaacccccaacacaacatgagagggcctggcccctgctagctgtgtgcttgtatttcagccactgcagggagaaggccagtggttggggcaacgtcttgggggtcccatcgggcccctgctggctgcctgggtatggccctggtgaggctgtctaggagatgttagcccagcgagaacatacccccaccctcatacgcgggtggaggaagggttttcacaaacctgcccctcccccatgggagaaaccatgtttccctgcgagattgggcaaggctgggtcacccccacttcttgctcatgccttctgtccctcgtcaccaagctctgcacccgtattctggagctgcctctgccctcccacccccaccccatgccctgcttcaagcctgcttccttcctcccctaagagtaattctgcagagatggaggggacatggctaggctgctcaaaccccacacccccagctctgccttcacaccccaggtatgaccgccccttggggacacctgctcttggtttccaacaatcatgaaagaagctgttttggactctgtaccaacttgtgccaggtactttcacatacactttctctcatttagtccttgcaaaagcttggccatgtagtatgctcaatgtacagatatgaaaatcaaggctcaggaaggcttgttaacttgaccaaggccaaacagcagatgatggtaactaacacacactggctccttcctatgggaccaggcacagtgccaagagcttcacccttttgtgggggtggggttgctatattttgattcccattttatctgtgaggaaactgtagcacagagtggtgaaataacttgtctgaggtcacacagctagtaaggagccaagctgggatttgaacccagatagtctgactgtggtctgtgctctgaaccactaccctctatggcttcttggctatttacttgctgtaccaatgaactggagttaaaacccaggtatgtcatcatttccactcatttgagctacttcagcatttttatcagggcagaataaaaaaaaatgatgagctttttttttgtttgttttgttttgtttttagaaacttatgtgatgcttttctcacataaaagccccagctttgttgaatgactggatttcaaaccaaaaaaaccacacacacacacacacacacacacacacacacacacacacacacacagcttaggcttatcattctataaccgtttcccatgcactgtcacttcattcattcctgtccttagtgtagcctgtcaaggatctcttagcagttcagaccccagcctatcagttaagccatgcagctgtgtgtgagctgaacatctggcaagcaggcaatattatctttaagcaaagaaaaggaagagaaagagaaggaggaagaggaggaaaggaaggtattcttatttactagtcgcaagcactggggttaagtaccggacttttattctctcattgaatccttacaaccacgttcaagagtgggtgctatcatcacctccatttcacaaataaagaaagtcgggggtgagagagaaggaaactatgtttttagccattcaaccaataggaggggccacaccagggcatcacctcctcgatgcacatctgccaagtccctgctccatctgccggggcccagggctaaagacggagatcagacccatcctaccccttgagaacttcccatccctgacaggtggtcagcctgccgcacactcctcagccgcacaacccctcagactacaccttctagaaagaccgattcagaacaccagtgtccagtttggttacttggctgggaagattccttttaagcaggggggagaaaaagtagcaatattaaaaattaacgtcgaattaaaaattaaaatgctctatttcccagctgttaattattaaattccactggcaattccaacatgtcagcaaccctgactaggaagccatatgacaggctgaaaacactggccgtgggcaggaggaggaggtgggaggatgattgagatcagcttcctggatgaacctctgctcaaaccccacccccaccccggcccacagaaaaagaagaagtaacagcaggcaggccaagtatgtgtaagagcaagagctgcccaacgtcatcaagagagggctcgaaaaggagggaaaagtccaggaaacactggaaactgctcagttttttaagccgggcacccactgcgttacttcggcatgtggggttccaccagtgcaaaccaaagacttccacaaaataaaagggtctccaaaatccaaacgcaccacctacctaggtagttggtagcttttcaattttatgtacttatttatgggtacactgtggtcctgaagggctgggcagaggaagtgttaaaattctatgaatcatacagcaggtggaaaaaaatgaggaatgcaacaatgtgttacttactggattccttccaggcagcaggacgtacacagtgatccagcaaagagctaatgatgccatggacaagggtgatggagagagggagatgacgtgggaagaatgaacagaacatgtagatgaattagactgtgggctggatgaaggaaggatgaacagtgaatcatggaggtctcctgactcttgcttgagatgggaaatgagaagaatgagggtggggtggaatcaaaaactccctctgggagttcccgtcatggctcagtgggaacaaatctgactagcatccatgaggatgcaggttcgacccctggccttgctcagtgggttaaggatctggcgttaccgtgagctgtggtgtaggtcacagacacggcttggatctggtgttgctgtggctacagtgcaggccggcagctagagctccaattcaacccctagcctgggaaactccctatgcctcaggtacggcctaaaaagacaaaaaacaaaaaaacaaacaaaaaaacccaaactccatctgagtcatgcgagacctgcagtgatgtcaggcaagagttagacacaactgggtgctcagagaaaacctttgggctaaagatataaatgcagtagtcattgtcccatgaatggtatctaatgccacagaaatggatgaagacagtgtataaagaaaagagatgaggataatggactcaacctccagaaactctaacacttcctggctgagaagagggaggggccccaatcaaggagactgacaagggagctggagaagtcggaggaaaactaagaggatgtggtgctacagaggctgagagatcttgatgtaaaaatgtatacagaatacacttaatatgtttcaggtagaatacagaggacacatttctataaatatatctataatatatttctataaatatattaattcagtggctcatctttcctgcatttatgcaagcaatttactttggtgccctgagaaggcttagattagtgctactacatatcaatattctttaaatatctgctcagcattcatttggaggagaaactgagccatgcatgggggaaagtggaaagagtgacagtgggtggctgtggtctttcacctctgaccccagtgattcagccctggctccacctctcaagtcccactcagtaaagcacaagtaccacggtcagtgtgccactctctcttgaagggagcttggtgactgtctctagctgatctatctggcccctggggagtctcacacctccccacatgcacacacatctaaggggcttatcaaagctctggtgggagttcccgtcatggcacagcagacatgaatccaactagtatccatgaggtcgccagttcgatccctggcctcactcagtgggttggggatcctgcgttgctgtggctgtggtgtaggccagctgctgcagctccgattagacccctagcctgggaacttccatatgctgcaggtgtgccccctcaaaagaaaaaaaagttatagtgcttccacattcttccacttccaggagtagcttagcattccatagatggctaccctgtgcccagctcctcaaataacacatggggaggccaaaattcccattctttcacactgacatggacctcccatcctaaaacagtaagaaacttgccagaacatactcagtccttccagagtccaagacccctcatgctggaatagatgctattctcctcggatcctcctcctacctctactgctgctcccactccgtttcagacttcttttcctccctcccctgaccctttaagtgctgatgtcagataagactcagctctgctcctctgcctggactctgatggctcctcttccaatgtctctaccacatatcttctgccagcttaaaggccctgctgtacactgacgattatgtctcccccaaattcgtgtgttgaaacccaccctcaatgtaatggtattaaggggtggggcattggggtgattagatcctgagggtggaaccctcaggaatgggatgggtgcccttagaaaagaagccctggagagctccctctccccttccatggcctaagaacacaatgagaagacgggcatgtacaaactagaaagtgggttctcaccagacaccacatctgctggtgccttgatcttggacttcccagcctccagaacggtacaaaatacatttttgttgtttataagccaccccgtctatggtattctgttacagtagtctgaaggtctaagataggctctccatgaactctatccaaatgccccacaggtacctgaatccacctacatccttaatcaagctcatcacctcccctattcctagacctgtatctcctcctccagtccctttcctggtcaacggcaccagcatgcaccagtctctcaggcctcccagtcatcccggacagcccccaccttctcactcccttccacatcctttcaagtcaggttaatcacaccgccttaccaatcttggcaaatgctagtttcacatctagtgcccctataggactgtaaacttcttgaatataagtgtattgattaatttctcctgtctgtctcctgtgcctaacacaatgtctagtaccgtgactcatagtgaaatatatcctacgtcacaaacacatgcacatacacatatggaagcaaaaatgccactaaacaatacttatccttacttcatgagatgccttctgatttcctatttggtttcaatttttgacccttaagccagtttctaaacacattaatggatcaaataatagtctgacacacatgggctagcatatcataggtgttttaatgaacattgttgtatgcttgcttagagtgtgtgcatggccttgtaaggttttttaatcatcactgccattttattttatttttatttttttagggccacaggtgcagcctatggaagttcccagtctaggggttgaatcggagctgtaattgccagtctgcaccacagccacagcaacaccagatctgagcctcgtctttgacctacaccacagcttgcagcaatgccagatccttaacccactgagtggggccggggatagaatggatactagttgggtttgtttccactgaaccacaatgggaactcgcgtcattgccattttacagaggagttaaccgaacctaagaattttctttatctgattctagattctgtggctttccacagcaccccatgggctataggacctctcctagccccagtatttttttgctttttaggggctgcacccgcagcatatggaggttcccaggctaggggtcaaactggagctacagctgccggcctaccacagcaacgccagatccgagccacgtctgcaacctacaccaccggtcatggcaacgcgggatccttagcccactgagtgaggccagggatccaacgtgaaacctcacagttcctagttggactcatttccgctgtgccaccacgggaactgctagccccagtattttgtgattcatctgttgccattggctaattgctgtcagaatcactatgttgttgcgcaaacatttgagtcaaaacatccagactccccacctcccgggatgccacgccagtcactcacacacacacacacacacacacaaaatccggaccctgttttaagggtctaatagatgctaaaactctgtctcccctgtcgggaatgttctcatggccctgttgcctacacagcccctgccacctcctgctgagctgtggatttactgaaatagggcaacgcttcttttcttactcaggattaaaccagtccactagcggaagctctcctctgttgtcttcttttctttgttccttttcgttgcctatagcgtcttcttcttcgtggtaactgtgagtcctacgtacaaacggaaaacaagctgaggaaggcagggagggtgacccatgtgccagaatgagagtgaggatcttgtgaaaacagattccaaggcagagaacacgtgcgccaagcaaatgtctacagaaggcttgtgatactaaacatttattcgtaaagacgtccgtctgatgaaaaggttcagtgctcccctttttcatcatccttccagaccagcacagttagcaatgtaatgacccagcaattctcaggttctgtcaggagcagggaaacctgataaaacagtccttatcagcgtatgtaagctcatgacagcctttcctgcagcctcaacttcagcctgagcctcactcactcccacatcaaatgggaaaaaacaaaaccttgaaaaccaaacttaatgcccatccccaccacgcaacagagtccttgcatgattccaataagccagaaggacgaggcgactgagaaggtcatggctgtgaaaccattttatttggactctacagccttgagcagatacacagatggccgtttcccagtcttacccattgttaaaccagctcggaaaccaccagcccctctgagcactgctgccaacttctgggtttctaagaaatgaaaaagatgacaaacattttttagaaaatgaggcagtcccaaactggggcagggggtggggggtgttccaaactctttttatggcagatcacttaaaatcattttttaaaaaatcactaattcgtaaaatgaacagaaatgaagctgctccagctgaatgactgaggatggacccgacactccccagatctcccctcccttgggtggcccccggcactccgctggtccagggagccctcgcaggaagagaaggggagaagaagaatgacaagggggagggcactaatccataaatccaagtcctggatctgcccctttcctgttgtgtaaccctgataggacatttttcctctctgaatcgccattgcctcctctggaaagttagagaacaatgacagcaccaaacctaccatgaagatggatggcttcgaagactaaacaaagtagcctacgtaaaagagctttataagctgaaaattactgtagtaagttgtagtcttaaaaaagaaaagcccacatttccaagaatgatctcttgctaaatgaggagaactggagttgctacaaaggtcagcagtgacagattcaggaaacctgagggtttctaaacccgaagctcagcaaactgtaatcagaagccgtttttctccacacacatgctcagatgtccacactcactgtgagagtctctccaaggcgtggaccgtctagaggagggacaagagggggaaagccaggagctgccatgccctttggttggacaaatgaggtggtgaggcaggaataggcatagtagtaagaaacttactttattttactttattattttattttttttgtttttttagggccgcacccgtggcatatggaggttcccaggctaggggtctaattggagctgtagctgccggcctacgccacagccacagcaacttggaatctgagccgcctctgtgacctacaccacaggtcacagcagcaccagatccttaacccactgagcaaggccagggatcgaagatgcatcctcatggatactagtcagatttgtttgcactgcgccacaactggaagtccaagaaacttaaagtccatctactttcaggaagtgcttgaaatggcttatgaagaaagtgtggttacgataaataggaaaacaatacaagaatcaaaacaaaacaaaacgaaacagagaaacattttagtcactcgggtgttttcacatgactttggtcatcccagccactctgtgagaacaaaatctttaactttatttttacttcatagctaagatattggcaaaatgagtttgagcaaattgccaagatcccatggcatctaacaaaagccaggatttaacaccaggggataaatcatatcagatgaaggctactataaatcagctatactttaataagaaaaaatgttttaaaaaaaatgaaggccaaggaaaatgcaagcatttaagcacaatactttgctctaagcttcctagcaaccaagtcgaagataggaaaaaaaaaaaagaaaaatgaaggcttagagtccttaatcaccagtaatagtaataataataaataataataatacacacactagtttatcaggacacccagcctttcttcctaatcctttgtcttggcaaaatttctggcaagggtctttataccacatgtagtaggtagcataatggataatatctactctgattcttttttatgagcaaggcaggaatgttctccaaacaacatcacttaaagagatagatacttgatgagaagcaaaggaaaaacacaactcatgctctagaaaggcaagtctaggggctggagaagtacagctcagacccctggaaccccatccctctcctccacctaggaccacaagtgtgtcaccacctgccatgttaagaatggactgtagggccaccagggtcacatggaaggtgacctagagatatctggaattcaaagcacttactttgactggtatatccagaacaaagaaccttctgggctaaaagcaaatggaaataaaaacatatcatgttacttggaatgcagagaaaagctattttgcaatcattatcattgaaaccctaggctgagctgagagcctgggttgtggctactcccaggtttccaccttcgagatcgaaaaaatgatatcacgggactctcgtcatttcagaattactcagatcaaacggtgggagggaggtctctggaaaatatcaaatcttagtttaaagaaaaaaaaaatagatggcagctcttattgtccaaggtggctttgctgagggagagaggctccagagatgggtcccaggaagaccacagcccacccatccctcacccaggatttatcttcctccagaaaaacaggtcttgcctcgctggctcaaagctgtctacagagtagcctcaaagggcacttctaggagttcctgctgtggcatagtgggttaagaatctgactgcaggagttcccatcatggctcagtggttaacgaatccaactaagaaccatgaggttgcgggttcaatccctggcctcgctcagcgggttaaggatccagcgttgccgtgagctgtggtgtaggtcacagacaaggcttggatcctgtgttgctgtggccgtggtttaggccggcgtctacagctctgattcgacacctagcctgggaacctccatatgccgcacctagaaaaggcaaaaagccaaaaaaaaaaaaaaaaaaaaaaaagaaaagaaagaaagaaaggcagaaaaagaatctgactgccgtggcttgggtcgctgtagatgcacaggtatgatccctggcccagcacagtgggttaaaagatgtggtgttgccgcaactgcagctcaggttgcacctgtggcttggattcaatccctgacccaggaatttccttctttctttctttctttcttccttccttcgtggaatttctatatgccatgggtgtggccattaaaaaaaaaaaaaaaaaaggtacttcttaagctaacaaaagcagtgagaccatcctacaagacgggatcagtaaatatatgacgactctagcagaccgcctccattcattcaacaaatacctgctgagcatgcgttacatgtcaagtgccagacatacagtgttgactgaaacagacaccatgtgtctgtggtgtagagaagctggcagggagggtggaccctattttgataaacacatcattataggacttcaaaactccaagaaagcataggagcacttaacaggaagacctcgaaggctccccaggggaggggatgatgttttagctgagttctgaaggatacataggaggcccagtgaagagggattagcaagagtgtgcctaacagagagaaaaacatgcaaaggccccaagaaaggaaggtcgcatatttatttatttattcatttatcttttggggttgcacctgcggcatgtggaagttcccaggctaggggttgaattggagctacagctgctagcctacaccacagccacagcaatgccagatctgagctgtgtctgtgacctacaccacaactcacggcaatgccggatccttaactcactgagtgagtccagggatggaacctgcatcctcatggatactagtcagattcgtttccactgcgccacatcggaaacgcctgccctcatctcttaaaacagaaacaaaaaaccactaaccactaatatttgtttgagattctgccaaagccccgatctcctccctctgccttctgccccagctgggagtccacatctcctggtaggaatgaaatacatgccttcctaccacctatggtttcccctctaagctcagtacccatggacccagctctaaagtcccttgtttctaaatctgtctattgatctgataatattcataatagctaatagttggctggggacctttctaagcaactgacatgtattagctcattaaattctaataacagtcaatgaaggaggttctattcctcctcagagggacagaggcaataaattattttgcccaaggtcatactgctaagggaagaaacagtatttgaacctggggaatctgacttcagatcctacaagagggggaagggaaaggggcaagaggagggggagggcccgtgccacccagcactcaggagccccaccctcctgccgaggcactcagggcatcaatttatagatttggatttgccacctcgtcccatctttttagtaacccctccctcttcctcatctcaccctcctttcccagaagccttcaacacctcaggtcacagcaacaaccaccctgaagtgtacggcatttaacacatattcatccttcaaggcacagctcggatgccatctcttctgagccttctttggtatgaacctagcacaatgcctggcatacagtaggtgctcaataaatatttctaaatgagggagttcccgtcgtggcgcagtgcttaacgaatctgactaggaaccatgaggttgcaggttcggtccctgcccttgctcagtgggttaacgatctggcgttgccgtgagctgtggtgaaggttgcagacgtggctcagatcctgcgttgctgtggctctggcataggctggtggctgcggctccaattagacccctagcctgggaacctccatatgcctcgggagcagcccaagaagtagcaaaaagacccccccccaaaaaaataaatgcaaaacatagatccatctccaagccaaacataatcttgccctccctgaactctcacgttcctttgctctctctctctgacatcctccttctagcctgtgttgttgggctttcatgggtacctctgcctgctccatctacagcataaccccttgagggtagggattctccttggcgcacactgtacccctcgcagcatttggcatgaacaaccagctccagaaggagccccagatgatgaatcagaagatctgagttctaattagaagttagacataagttcactgttaaggcatttcacctacttgtccatcgcctgaacaatggaaaccttgactaaaggaagggttacccaggttacccaagtcagacagccctggacctaaatcttcctaaaaatgtgaccttgaacgttcacatttaatattgtggaaactcagtattcctcatctagaaatgtggactaacactgaccttccagggctgttttaaaaacaggagggaatgaacagtggagttcctggcacaagcaaacactcaataactagtagccgctaacatcaaaatcaccatcaccatcattactttattatagctcttaaagtttcttccacctctaaaattctaagcttgtggctcagtggcttaagaacccaactagcatccatgagaatgtgggttcaattcctggcctcactcagtggattaaggatccagtgtttgccatgagctgtggtgtaggtcacagacggggcttggatctggcgtggctatggctgtggtgtaggcagctctgattccacccctagcccaggcatttccataggccacaggtctggccctaaaaagaaaaaataaataaataaaattctaagatttttttttttttttcatctagcctttaaccaaatgctgtcctggatgacattcttaaacagctgtatgtgtttgatggagttattttgtaaatctctttttttttttttttcaagggccttacctacagcacatggaagttcccaggctaggggtcaaatcagagctgaagctgccagcctacaccacagccacagcaacaccggatacctgacccactgagcgaggccagggatcgaacctgaatcctcatggatactagttggatttgttaccactaagccacaacaggaactcctgtaatcctctttagctacagtgctacccacctgtctaaggttagtgccctcagctcacctcagaccaattcacaaggtggcaaagaatctcctgccttttaaaccccttgcagatgttcaaatagattcctcacattgaagaatgatgtggctgcagtctgggtgccagactacggccctgaagagcagccagaatctgctccagttactgtgaagagagagtgtgcccagcactgcaaaacaaccctctttatgggaggccagcaccaatatgcacttctgggcctttggcttctgtgttttaattttgtgaagtacccaaaatatggaagtataactctggctgcaattcaaaacaatcaagagttcagagcttgaaggttgcctacacaagcatctcaactcaggtcaggaaccccatggggaacttgctcttctgttagattctttcagcccctagaattttttctttttctttttcttttttctttgtagggccaaacctgtggcatacggaaattcccaggctaggggtagaatccgagctacagctgccagcttacaccacagccatagcaactccagatcctagccatgtctgcaatctacaccacagctcatggcaacactggatccttaacccactgagcgaggcgcgggattgaacccgaaatctcctagttcctagttggattcatttcccctgcaccacaacgggaactcctagaactcttccttctatttgccaaaatctcctgtcctatgctgccctccggacagatggtgatagtggtggtggtgatggcagccagcgcttactaagtacgttgcccttagtgctttattcacaacttattttatccaacaaccctatgaagcaggtactactatcatccccatttttaaagatagggaaacttgcccaaagtcacagaggagggaagtggtggcacaggaccaaccccaggcagcctagctccagcctccactgagaatatctcctcagtcctcaagtacctaagggagccccagggtctctgcatccaacgctgtcatcttttcttcagaggaagtaccacagtttcctcaattcgaaaaggttggtttgtagacatttgttcactctctagctcgtcttgtttttcttaaaatgagttcttcagaatgagagggaataactgttccagaagtggttagatctatgaagcatccaaaggaatgacagcttcttattctagggaatccacctcctcctttttttttttttttttttttttttttggctgcacctgcagcatgcagaaattcctgggccagggatcaaagccaagccatagcagtcacctgagctgctgtagggacaagactgaattcttgaacccgctgagctaagagagaactccctagagaatcctccttctactgatggacctgaagatgcagttcctttctaagtggccaaaatggtcctgctggctcatcaagtcttagaatttaagagacattctaacgttaatccaggccatcatcctgaacttgaggggctactaaaacactacccatcaaaatatcaatggtgatgacatagctctccaggccaagttgttttttggttttttgtttgtttgttgtcttttttccttttagggccacacctgtggcatatggaggttcccagactaggggtccaagtggagctgtagctgccggcctacaccaaagccacagcaacaccagatccaagctgcgtctgcaatctacaccacagcttacttcaacacccgatccttaagccactgagcaaggccagggattgaacccacaacctcggggttcctagtcagattcattttccgctgcaccaccacgggaatgccttcaggccaagttgtaaggtggcctttttgaaagaaagtccaagcggtatcaatacctcttaagtcaaagccatcatgcattttggtagctgcttgcagacatttctttctgtcagaagcgtctccagctggaatctccaaggcatcgtagtttccaaaagcaaagaagcagcgtcaaatatttggggtgaatccactgatgaatttgaaaactcagaaatgtttaattcattttgctttccagagttaaaaaaaaaagacaaaacacccaaaagtttagccaggcacaaatgaatcaccagcgactcagtgtgttttgcagcaaaagtcaacaacttgagttgttcctttaaactctgcaaatattttaggattgcaaaaatcagggtgtatttctcatggaattcctgtctgaaagttctcaaggtaacttccatatctggtcatataaataatttaatattatatcttggtcttaacatgaccttattatttctggctctagcctacccagaactgcagaggtataaaaatcaggacaatggcaacatggcaggaaggaagataattaattagctggaaggtacttgaagatctaatgactttaaagacggtatttaagggctcagggatacaggaagggtagaatattttctttctttctttgctttttagggccgcaagtgtgggatatggaagttcccaggctaggggtcaaactggagctgaagccaccagcctacgccacagccacagcaatgccagatccgagctgcatctgcaacctacaccacaggtcacggcaatgccggatccttaagccaaagagcaaggccagggatcaaacccacctcctcttggatcctaattgggtttgctgcccctgagccacaacggcaactctctggaatgctttctttacggtgtcagtgaatcctacttttaatgcaagctggtgacttggctgataactaggagattagaggagactttcatcaacatcatttcatcatgtttcataattacctgttgatgtattcccaaaacacaaccattacagttgagacaagcagcattgacagaaccactcttcctttgacattcattattttctcctgggaaaagaaaaggagaagggaaaattagattaaatacacccagagtggaatatggttttttaagaagtgcttataccaatatcttttctaaaaggaaaagttgatgaatagtcaacgagcgctaaggagtgcgttctaccttaatttgcataggcctacactggcaaattagccaagtcaatgaactgacagggccgtctgggttgggaaggatactaaggccattttgaggctcaaaggggaagcatcctgactgatcccaaggtccaccgagatgtgggagagtgacgggtttagttaatggtccctaagggctccagccgcccccaactcagatgccccacctcgcatcacagactagaggaagcatccgtttcctaggtctactgtccctgatatactgactatgtaccttatcctcaaagaaaaatataccctggtcctttatttaatttcatttaaattttagggccacactcacagcatatagagattcccaggctaggggtcgaatcagagctgtagccactagcctatgccacagccacagccacactaagtccacgccttgtctgcgaactacaccacaactcacggacagcaacgccagatccttaacccactgattgaggccagggatcaaaccttcgtcctcatggatgctagtcagattcatttcagctgagccacaatgggaactctcaccctggtcctttataatctaggctctgccacttcccacccagcttttccccaatgcacccacacaagtggcaaacagtcggtacattcgtatttcttgatcgctgcatgaaattgtagttgaagagggaagggatgctgggtggaataacaggttgcggagtactttaatttgggtggagatagaaagatatttatttcaaatggaaaggacaagaaaagtgtggcagctagccacatatcagcaatactcataaacaaagaatgtaacaaaagataaagtagggcattacataataacaaagggatcaataccagaggaagacataacattggttaacatatatgcacacgatatcagagcacctacatctagaacgcaaatattaacagacataaaaggaaaacttgcacaattacataatactagtagaggactgattcgcaacattttgtgggtcttgtgatttttttctttttaggtctatttgtctttttagggccgctcccgcggcatatggaggttcccaggctaggggtcgaatcggagctgtagccaccggcctacaccagagccacagcaacgcgggatccaagcctcattggctacctacaccacagctcacggcaacaccggatccttaacccactgagcaagggcaggaattgaacctgcaacctcatggttcctagtcggattcgtttccactgtgccgtgacgggaacgccaacattttgtgttttagatgtcatagtttacatcttcacagctatccttcaactatataatttagtcttttaacatctgtactagtttatttaagtgtttgatgcaacaccttcactatatatttgacttttctagtcttattatttcctttctgtattttctcatatcttgttacagttttttctttttcatttaatgaagacacaaacatttcttgcaagtcagtgtagtagttggaaactcagtttttccttctgggaaactctttagtcacccttcaatttggggagatgactttagagcttcccaagggatgaagataggatgggaaaggatgacaagggccgtgagaagggatgagaatattttggaaacagcatctataccaggcagacaagagaaagagctgctcgtgtttgaaaaaaacaaaagcaaaaaacctggacaagaaaaaaatagtgactgacactgtcccccttgagtggctggtgctaggcagtcagaaggggggcagaggcagtcagaacctggaaaggtatggaaagtagggtggggaatcccaaaaagcatctaaagctggagaatcccctgatccaacttcacctagagagacccatctgggtgctgagtgtggagaatggagaaaaggacaagggcagaccgttctcatgaccataaagaggaggtggcctggctcaaagggtggcttgattcaaaatatactttgggagttcccgtcgtggcgcagtggttaacgaatccgactaggaaccatgaggttgcgggttcggtccctgcccttgctcagtgggttaaggatccagcgttgccgtgagctgtggtgtaggttgcagacgcggctcggatcccgcgttgctgtggctctggcgtaggccggtggctacagctccgattcaactcctagcctgggaacctccatatgccgcgggagcggcccaagtaatagcaacaacaacaacaacaacaacaacaaaaaaaaaaaagacaaaagacaaaaagacaaagaaaaataaaatatatactttgacaaataccatatgatatcacttataactggaatctaatatccagcacaaatgaccatctccacagaaaagaaaatcatggacttggagaatagacttgtggctgcccgacaggagagggagggagtgggagggatcgggagcttggggttatcagatacaacttagatttacaaggagatcctgctgagtagcattgagaactatgtctagatactcatattgcaacggaacaaagggtggggggaaaatatacatgtaagaataacttgatccccatgctgtacagcgggaaaaaattaaaaaaaaatatatatatatatactttggagagagaattgataggacgtggttggtaattttgttatcagagatgagacaaggaagacccaagatttctgcttaagcaggggggttgtagtattttctcagatgggctggaggaggaacaggcttggaggataataatcatgaattcccttttggacgtgtgaatgtcggggagtgtgcgaatacctaaaaggggacagggagacaagtggacattcaagtctaaagttcatcagagagatgtaggcagaccatgcaatcggagaagttgttcatggaccaaggaacgtatcggatctgacgtgaagggaacgaatttgattacccaggagagaatgcagagagagaaagaggaagaggaggatgctgggctgaagctttagaggtaggatagaggagggcccagaaggagaggaccagaaggtagcagagacagaagagtggacacctgggagccaatgtcactgcctttgtgaagccacttcccacccccaccctgaccacggctgaagcccttttctctcctccggcccccatccctctattcctttgctgtacacatcgccctgggagtcggctcaccggataagacctgcattttgctctgcctcctctacctgcttgtttgagcttcctgagggcaggagggatgacttcttcgtcacccctgaattcccagtgccccacagagagcagagaaggccgtcaataaataatgagtggtttgagcttcctgagggcaggagggatgacttcttgatcacccctgaattcccagtgccccacagagagcagagaaggccgtcaataaataatgtgtgggagttcccgttgtggctctgtggttaacgaatctgactaggaaacatgaggttgtgggttccatccctggccttgctcagtggcttaaggatccggcgttgccgtgagctgtggtgtaggttgcagacgcggctcagatcccgtgtggctctggctctggcgtaggcctgcagctacggctccaattagacccttagcctgggaacctccatatgccgcaggactggcccaagaaatggcaaaaagacaaaaaaaaaaaaaaaaaaaaaaaaatgacgtgtgaatgaaatgagaatggcactgagatgtgtcctttcaggggacgggttattctccaaatatttgcagagagggttctgaggtgactccaggcttagatctcaggtgctccatcacctctgttgtgaaatccagttaaagaagagaaagtatgggattatcagccatgtcactctattccttcttgcttggaaagtgagctctgtttggaaacctctgattcaatcgccacctttcggatacaatcatgataggtggtgttccagagacggtgagaagatggggagatggagcttctttcctgtgagcacctcaggtcctggcacaaacagcccggggcccagggcaaagttacgaaatgcacggggctacatgcagctcggcccagatgctggaaaaagccacttgactcctacaccaacagcattagcactgagtgcgaggaaaggcctgggtttgggagcagacagatcggggtggagactgtggccactgtggccatgcctctctgccgttgtcttcactcccagagaagtgtgggtggtgagagagcttgggaaggaggtggggtctggagacacccacagactgggtaaccctgaacatggagcagtttctcagaccctcatccaactccaagctctgaaaaccaaaagcctgtttataattcagttggcatccaggccctgacacgaggctatttataatctttatcacttagtgagactgtttaaacatttctttgcataaatattgatgtacattgttatgtgctgttgctgcactggaggcgttacataatataggataaatattctgcatttgaaaaattctaaattccaacatatctggccttaggcattcaggaaagggatggtggacctctaattgatcacattagatgggtctcctcatctttaaaatgggaattaaaatggtgatgactgcaagagatggtgtccataaaatatttagcatcatgcccagcatcatataaaagctcaaaaactgctagtttgtattactggtatccataaaacaggctgttgggaggatccagtgaagacagcacagcgcctggtacttagcaagagctcaaaacgtatcggagggaaaggaataagcattttggaataagaatgtgttaaacaataaagtacaaattgatgcaaattagggcctctaaaggtttatccatctgttctatgctgcagactgactaaaagctcctgggaaatgccacgcaactttgattttctttgatcaagcccaggccatccaaagccttgtcatccccacctgctgaggatcaaaccctgtgtaagaaatgcgaaagagagaaacacaaactcctggcagagaacggatcagggagaagctggtataaaatcagacacacctcctaatcctttctccaaaggcaagtgtttttctgtttgttttggtttcagggtttgtttgggtttttttgttttttggtttcttttggtctttttaaggccacactgggagttcccctcctagctcagaggttaacaaacctgacttgtatctgtgaccattcaggttcgatccctggacccgctcaatgggttaaggatccagtgttgccatggctgtggtgtaggtcgcagatgcggcttggatccagcattgctgttgctgtggcgtaggctggtaactacagctctgattcaacccctagcctgggaacctccatatgccaagcatgtggcacttaaaagattaaaaaaaaaaaaaattaaggccacacccaaggcatatggaagttcccaggttagaggtcaaactggagctatagcttctggcctatgccacagccacagcaacgccagattcaagctgagtctgtgacctccaccacaactcatcacaacatcagatccttaatccgctgagtagggccagggattgaacccttgtcctcacggatactagtagggctcattaccactgagccacaatgggaactcctttgtttcatttgtttttgatttttttttttttttttttttggtcttttctagggccgcatccacggcttatggaggttcccaggcaacgccgcatccttaactcactgaacgaggccagggatcaaacccgccacatcacggttcctagtcggattcgttaaccactgagccatgacaggaactcctgtttttttaatttcagaaattagcatcagagacaactcttgaagcccccccccccttttcttttcctctggaccgtaaacatggcttgaatctgcttacttttcgctgtggccaggcatcactcttagagacttacagttggaagccacccaaatgagccaatattgcctccttttgaaaagcactgggaaggggtatatgcaagctttctggaatctggaaccctagtgtctcaggaaagaagggttgccagaatggccaaagggtttttaaaacattttttttttttctctggattaaaatgaggcatttggcagcccatgtggtctaaagcccttcacggatgtgtttgtcacagaattttctaactctctaattctcaagattggtggttgactatcttacccaccaaataggaaaagtgggggttgcttctacatttctcatggaagagggagagcacaggattagagcctagagagcactagcaccctgtcttataagggagagtgtaaccacctcagcaccacctgggccccagccctcagaggatcaggtgaacccagcgggcccagttccacctgagccctcccaccatcccacaggccctcctgccaaggcgtttgccatttctctctgctcctgggccactcccacaactcagcccctgcagcggtttccaaaagaaaccacttgcacccccactcccgggcctcgtgcagactgtgctaaaacccagtgcatttcccaaggcagggccacgctggaaagcctgtcatttctccaccttcctcctcctcctcctcctcctcttcggcttctccatccctggggtatcagactcttccccaaggcccataaattaatccttcctgacccacccctaacttgtcccacacagaacggtacacacaccccctccacttcagagaagctcatggtttcaccgcaactggtccaagtcaaggttttccttccagacagagttccactctgaaaggaattctagtggccctgtttttctccacctcgtgtcagggggaaaggtgagcacctcagctgaatcacagagctctcagaagccctggaaaagccattatcttgagagagcagcgagcaagcagtgacagaggaaaccaaagcttccagcagactaaagaatcttcctctctgcctgtgactcttgccctgcccctggaacccatcctgccctgctagctccacaggaccctggcaagggtcaagaaagtcaggtagtgataagtgcagcaaatgaaacacagtgcgggggagggagccaaggtggggaagccgcaggaactgactgggtgttactcaccctggacaaaaacctcctatttttaggcctaacatttagatccagcattccaggcagaaattaggccggtgctgggactggaatctgcagccctacatgcacttgccctgggcaagtcctctggctctgagcctctacttacacagaccaaacggagcttcaaacaccctcctccagggctcttgaaaggacaaaaggagaccccgtctatgaagcatgttgtgcctgatgctcagtaaatgctccacaaatgcagccagaacaagggcgatgctttttacggggagagattcagaaatgtgtggctctgacggccgagctgtggctctgtctgagaggagtctgggccctccagggcagcaccacacagaagggtccagggcgagccccccacgctgttgtgactgttgttggggccagctcagggtccccaagcgcatctcgtttgcctctatcgcctggcgcgcatgttgggcagggaaggaaagtcaggctccagggtcaccccagcacccacacagagcgggtttgtgaaccacacgcagctttctctggcctcagtctccccgtcctttgaaacatgtcctgtgggcttaacttccctgaatgagccaagacctgtatgagaaggcagccacagagctggaaggctccttttatgaggacaggttcactggagctcaacttgctgcagtggccacagattcctagaagtggtgatcaaaagataggattgccagagtttccgtcatgacgcaacggaaatgaatctgactaggaaccatgaggttgcgggttcgatccctggcctcgctcagtgggttaaggatccggcattgccatgagctgtggtgtaggtcacagacgcggcttggatcctgtgttgctgtggctgtggtgtaggctggcagctgtagctccgatttgacccctagccaggaaacttctatatgcagcgggtacggccctaaaaagcaaaaaataaaaaaataaaaataaaaaaagagataggattgcccacaaaatgtgttgagccctcaggccacttcacccagaagcctccgggtcaggcccccaggcaggcctggggtgtggagtgggcaaggcccaaatgcttcctccaggtgaggtgctgcccctgcctgggggaatcgttccagcctgggtgcctgtcctggggctgcaggtggagcccaggtactgaccctgctccccgcacctacctgggtcctaggagcaacctgccccatccaggtagaccttgctgagctccttggagcctctcactttgatcccaaggagaaggagctgaacatgatgctacttggctccctgctcacaggtcacgatccagacctcacaatcacctggtggtgcaccccccactccagccaggatcaaagagctgaattctccaggactctggctggacccacctgagcaagaaactgccaaaagatggggcgtttgaaggacctggagcacctacacaccccaagctttcctcatggtttcagttacaagatctgtgtttggagacctccccttgggggcagggaccatggaaaagttccagctgcaagcagaccagctgggagtggaaatcatctcctcgggctgcaccatcacggccctggaggtcaaagacaggcaaggcagagcctcagatgtggtgcttggctttgctgaattggaagggtacctccaaaagcatccctactttggagcagtggttggcagggtggcaaagcaaattgccaaaggaacatcacgttggatgggaaggagtataagctggccaacagcctgcacagaggagtcagaggatttgataaggtcctctggaccccttgggtgctctcaaatggcatcaagttctcgagggtcagtccagatggtgagttaaaagtctgggtgacatacacgctagatggcagggagctcatggtcaactctcaagcacaggccagtcggaccgccccagtcaatctgaccagccattcttatttcaacctcgtgggccagggttccccgaatatatatgaccatgaagtcactatagaagctgatgcttttttgcctgcagatgaaaacctaatccctacaggagaagttgctccaatgcaaggagctgcatttgatctgaggaaaccagcagagcttggaaaacacctgcaggagttccacatcaatggctttgaccacacgttccgtctgaagggatctaaagaaaagcaatttcgtgtacgggtccatcatgctggaagcgggagggtactggaagtgtataccacccagcctgggatccagttttacacgggcaacttcctgggtggcacgctgaaaggccagactggagcagtctgtcccaagcactctggtttctgcctcgagacccagaactggcccgatacagtcaatcagccccacttcccgtctgtgagttcaaacacaccccttggttctagttttctgtggcctaaggaaatgtaaagatatgacctgttccagggtcaggctggaagccccttcaggaacctgtctcctacgcagagataagatgaagatttagaggttttaaaagtgatcctgtgtattactcagccattaaaaggaaagaaagaacggcatttttagcaacagggatggacctagaaattatcatgctaagtgaagtcagtcagacaatgagacaccaacatcaaatgctatcacttacatgtggaatctgaaaaaaggacacaatgaacttctttgcagaacagatactgactcagagactttgaaaaacgtatgctttccaaatgagacaggttgaggggtggggggatgcactggggttttgggatgatcatgctataaaattgcattgggatgactgttgtacatctataaatgtagtaaaactcattaagtaataaagaaaagaatgtaaaaaaattaagaaacagaaaaaaaagtgatcctgtgaattaaaattacacaaatggtagttgtcatgataatctgaatattgatttctttcacaatgactggctccaggccaagtctaatggtcagctctattctctgtgtagtgaaaaagacccaaccatcaatgtcatcttctaagccctgaccctaatccagaagtggtacccagatccttgtgttggctctgtctctccactctgcttcttttcactccttctttctttgatcctactcattcctttttcccttcctcttctacctcataccaccttgatctgtgcagcactttggagttttcagaggtcactgagctcattcaacctggtggtagagggacctctctgcctcagtaaaagaatagatgatgaagtgagccacctgagaattaggggaggtaaatgacccacctaaaggcgcacagccaggaaaaatttagcctggattcaagatcaggtcatgcaaattcaagtccttctttgcctccacttcagtcttccagagcattcctggagtcattaatgggaaaagggggggtctgacccttactctgttaaagccagaccttctttccagatatcacttttataagaagccctagtcagagtttaaatgtatctctgagccttataaatagtgtgacttaaaatacaagatctaaatatccagaaaaaaaaaatctgtgaatttgattctccgcctttggggttactaagaaagcccagcctagccaagacatgggaaggaagccgctggagacaagagctgtgtgagttcgaggagagggccttgctgggactgcacgctgcaccgagagcagactgtatttggtatacgaggcggagttccctcctctcctaaacaattgaatcacgagtgatgggtttgtgttgatggtttttaaagaaatgttatcttatactcctctacactaataatcagttgaaataaaaccaaaatgtgcaccctcagaaaaaaaaaaaaagaataaaaagaaactgccaaaagactgacagcactaataacaagttatgaagctgaaagaagcttctcaaaactcccaggaataaaaagcaaccactgattaaccatgctagaggcagaactgatttgtcttcctttttgtctctcttaaaaatgatactacaggagttcccgtcatggcacagcggaaacaaatccaactaggaaccatgaggttgcgagttcaatccctagcctcgctcagtgggttaaggagccagggttgctgtgatctatggtaggtcacagacacagctcagatctggcgttgctatggctgtggcgtaggctggcagctacaggtctgattagacccctagcctgggaacctccatatgccatgggtgtggtcctaaaaagacaaaaagaaataaaaatgatactacaaaaatcatcagataaagagatagttcaaagtatgcagccaaaatatgagaggtacatcagacagctgagtaatactaattatttttatattattttcacgtgttatggttgtttttctgaatttggtcctatttagagtattggtcagtctgtgttagctgttgggatggcacctcatattctaaatgcagtcagccttctgtatccatgggtcttacatccacaaattcaactaaccacggatggaaaatactccaaaacatcacattccagaaagttccaaaaagcaaaacttaaatttgctgcatacaggcaactatttgcgtggcatttacattgtattaggaattataagtaattgcaaggtgatttaaagtatatgggaggggagttcctccgtgggctagctggttaaggatccagtgttgtcactgctgtggcaagggttcgatccctggcccatcaacttctgtatgccatgggcaccgccaaaaaataaataaataaaatatatgggaggctgtgggttatgtgcaaatacgatgcccttttgtgtaaaggacttgagcgtcctgggatctggtatccgtggggtcctggaaccaatcccctgtggatacccaaagacgactgcattcaatccccagccaaatcatgtgtctgcaaatttgtgttcccttttcttaaagcaggccctcgatattgaataagcttcctgcagcacttggatgccccccagctgaaccagaccaggcctcaggctaaacgctttaccagaggtttctcagataagtctcacaacgtcctgtgaagtcattctagtgttatctccactttacagacatgcaaatggaagctcagaaaggtgaagtgacttgcccagtgtgtcacacagcataaagtgatggagctgatattcaggtccagagagctggcctcagggcccacccttttaactattctcagtaaacatgaagactcacccatggactaatcacccagggatctttggcacatcctctcattttgcctttcacgatgatcacttagcaattgacccaaagctagccaatcatgggctagactcagcaggggccagcttctcctcggcccagctggcgagcattggctcaactcctctgccatttccaggagcctcctgcgtgcctggtgtgagccttccccatgcacgccatcctattcacccctcatcatggtcagtgcgggggctttttagctgaggagaccgagctttagcaaaagctgagatcgctgggctcccccacaaggggggcgctgagtttgaaaagcagaccctctgcctcccaggcccagctcttggccgggggatggtgctggggggaaggagggagagtcctgctttatctaaaacctctttaaattggcttgcattacagggaaatgctccctgttggaagaaacatggtataatttggggggcaggggtggggggggagtagtgcacggaaggctgtttccagttatgtttttcattataagggtcaaagcaaacacagacgcaggaagctaagagacaagcctcagactaaacatacgaccagctgtcgctccagccatcacagacctgttctcggagggacatcttgtaggcccctttcttgaatccccttcaaaaatctgaagcctggatccagccagcttctccttgctgcctggctcagaaatcatggtgcaagagtttttccaagagaaatagggcgaggtacatgaaggatcggtgctgccctgagagggcactatgtccgcccccagcacaggtcccgggcctgagactcgtcctcctggccccacaatggcactgtgtggcccacacagagaaccccaggctgtagccacaccccgtgaggtcctgccgggcagccaacgaaagcagaaccaacagtgactgagccagcatcctgccagctcccactcctagatccgatgccggggactggaggactttgtcttctttcagaacaactggggggagcagcaagaagtcagggggagaggggggctcctctctccacgctgcagccagctcatgatacccacccccccggtgaccccagcaaagcggaggcaaatcatttcaacgtttcacgtacctcatcctctgcttctctccccccagagtaaaaggcgaagcaagttctagtgagctctgctctgcagaaggaggcagggctgggaggaagggaaggtgctgcgttccaactcctgtcaaaagaataaacagcggtttcacgaagaggagcgcagacggatcccacagcagccaggggccttgttcctccttgctcgccctgggaagtgggctgtttatcaggcctgttgactcagagctgcatgccaaggcagagacgtctctctccggcccaggatcggcccggcctccttcactaagcgaaactacaggtccaaactaggcctggtggtggaggagggacagccaccacccttgggagagacacacaggccgcccacatcacccactcctcggcgaaaatgagaaccattctgaacccaaaccaccccaaatgacaactagcagggacagccaatggagaatttaaaaagaagggggcagaaaatggagaggggtggctaaaggagagcatcctcaaaactcccgttgaaatgctaccttccgagcctcttgttcgcatcctttaggcttcagaagttgttctgtttgaacactatttttatagaatgttctgagatctcctgcatggcaagccaagctataagaacttcaaaaggtcactgaggcccaacccaactctttggctgaataatgcttaaccctccccacacccacctcctgctcccaaaatagaatttcctagctggaagagacctcacagcagtggatttgtaaatgtcgcaacagctaaagctttaaaaaaaaaaaaaaaaaaaatgaagtcattctcagaaccccactatgtaaaacagaggacacagggggctttggctgaaggagggaaatgaagtaagtaggggctcagagcccccccacccattcttcccaagtggccccagacacttcctgggagtagagcctagaaaccccagactaaggagaaggggccgaaacctgacagaaaggagccaagaactgccccctcagcttccagcggatggatgcctaatttagcttctcactcctgttctggggaagaaattcaccgccccctcctctggggcatgagctagttgaccacagtcttcaagatctgcttaataaactactgaaatcctccctgctggcatctactaaagctgaaccaaccacacctcatgttccagtcattccgccccagattaatacctgaaagcaagtgcatttaagttcaaacagagacgtgacctgggaccaaaagctggaaaaaccccaaggcccatcatcagccagatcaggtgtggtccaggtgagggtcacacacatccgtgagaaggaaccagccacagctgctgacatcaacagggtaaatctcacacatggtactgagtcaaagcagccctggatgcttgcatttatttaacgttcaaaaatagacaaaaccgggagttcccgtcgtggcgcagtggttaacgaatccgactaagaaccatgaggttgcgggttcggtccctggccttgctcagtgggttaagggatctggcgttgccgtgagctgtggtgtaggttgcagactcggctcggatcccacgttgctgtggctctggcgtaggctggtggctacagctccgattcgacccctagcctgggaacctccatatgccgcaagagcggcccaagaaatggcaaaaaagccaaaaaaaaaaaaaaaaaatagacaaacccagggagttcccatggtggctcagcagaaacaaatctgaccagtatctacgagaatgcaagttcgatccctggcctcactcagtgggttaaggatccagtattgccaccagctgtggtgtaggttgcagatgcggctcggatcccatgttgctgtggctgtggtgtaggccaacagccacagctccaattggacccctagcctgggaacttccatatgccccaagtgtagccctaaaaagacaaaaaaaaaaaaaaaaaagacaaaaccaatctgtggtgccagaagtcagagtgggagtggtagagactgggaaggggaggctcagagagctgctgggggagggggggggcttgtcatgttgtttctcgagccaggtagtggttatgcaggtgtgtccaccttgggaaaatgcctcacaaacattccctttcagtgtgtgtgttaaaaacaaagatgcacagaaatcttcctgctggaagctgccttctcttgggaattctgacttcccctgagtctacagggtctcagggccacagggtcatggatagaccccgttttttccttctcttgggttcaacgccccaataccaagcaccacagagcacctaagtacggactcagggaagatctttcacattaaatgatgcaggcagctggactgtggtcaactgggagggaaagttcacagcatttggaggctcaggaactgggctaagataaactggtcctttcaagaagcaagcacccaggagttcccatcgtggctcagtggttaacaaatctgactaggaaccatgaggttgcgggtccaatccctggcctcgctcagtgggttaaggatccagtgttgccgtgaactgcggtgtaggttgcagacgcggctcagatcccacgttgctgtggctctggcgtaggctggcagctacagctccaacttgacccctagcctgctgggaacctccatatgctgcaggagcggccctagaaaaggcaaaaagacaaaaaaacaaaacaacaacaacaaaaaaaagcaagcacccatcatggttgccaccttccagtttacaaagcagcctctctcctttaactcagcaaatcctcaggctcacccgccccgggtcagggaagggagggaggcactgggagcctctgtgacttgctcaaagttgccggctggtgggtctgatgctgcccttcctcctgagctgcctctggggaacaccctacaggttcgtggaattagaggctccaggctcatgaatcagagcacgacagagtatgcaaacttggaaggcagaaaattcaacttccagaggatccgacatgaccttcctccttctccgacataccctgatgcccagactctcaaaacaaggaagcatgtacttccggtcattccttcatggagaggcagggaactgtagcaagtgagcctcaggtctgctgatcaaaggaggccagtggccatccaggtaggagtttggcacgtttcccagcccagccaggccgactaatctcatcactcaatgttccccaaggccccttccagccctaacagtccataggcctgtcagatgacagccagcattcagagcctgtccatctgccatgtcccctgcagaggagtgcagggccttggagctgcggctcagcagctgcagcccaggtgtgaagggtcccggcttcatgccccagaccccttccacctgagaaacacaaaggtccggattcccaccctgtgggagagggagaattaagtgttcttggcaaaaagtgctacagatacaaagattgcagctgtcacttttaatcctaaatacgtttagggcaggtataagacattcttgctgtcacttgtgagtgatggagcagtttagttggtttcctcttccgtgtggtgaggataattataatccccaccgctcggggtgggtgaggggcctagagcaccgtggttatgaatgtggactctgggcccaggctgccggagttcgagtcccaggcctgcccatgtgcgatcctgggcaatgtgcttaacctctctgtgtctctgtttctatggctgcacaatgggaacaacagcagctggatggtagctggcacatggtaagtgtctagagatacgtattacccgatattgcaagaattaaggagacacgcccggaaaagtgcttgaggtgctcaatcattgtccgtctctgctgttctattaatccgaggctgcagctccttggagtttacatttgtgtatcaaatagtcattttgaccacgtaaccctgcaggtggggaaaggtacggagggaagggttcctggcacgacgtttccgttactgttaagtactgccccccacacacgcctgtgagtatcagagctgaaacgatcttggcaaaagcccacataataaataacggcagtcaagagaggttgcatctataagtctatttccttgagaagagctggaaaaatgaaatcatgatgactcttcccaggccagtacattgctaatcatcttgagatctgcctctgccccaggtaactccaggacagactccaccaaagccatgctgaagcactcctgcctctgcaagcatccatcctgagcctcagccctcctcctgcacaccaggaagtccctctctggggctcatgtcagtccttcaagctctataggtcagactcttcctagagaagaaagaagctggctttgttgacagctggggagatgtgaggcgctcccacggaagggcgaggcccgggtactgatgacaccctgggcttgagcaccagcacaggtggctggaggatttccccacccaaggaaaccgctctattcctaccctctcttggtccttctcaccccttcctcaggccaaggaccccagatggaggtgagaaagaagcacctgctccttattcacaattgggcagtaggtgccagggggtacccttgcccccgaccccccacagaagttctcactctttcctcagtagagagaacctcaaagtcaggtaagtcagctccctgcctcaaagcaggactgctttttgaacacgtgataagctcatcttccgtcaaggtcacacccacgccccgtttagagcccactgccatccacaaaagccacataacatagaggctaagtaggagaaatattacaagcccaagttataagaaagggaactgaagatcagggaagaaacttacagagtcgtatggtctgagtcagcagccctggaatggaagacaagtttggggtctttctgtgagtctgtcccacctcagcctcgtacacccctggtggtggtgaagccagaccaagctggggatgctaacggaagcagaacaagaagagggtcatgaaccagattccactagaacccaagttctttggggggtgggagggagcacttgtcttctgtcttggtcacttctgggctttcctggtacctggaacagtatttgacatctatcagacgttcagtagatatttgctgaattaatgctgagtgaaagcctacaggagccaggcaggcagcagaagtatgtgaatttgaccaggtaaggatggactgtgataaactagccaaatcagatcaaaatcagattttaaaaagaaaacaggtttcccattgtggcttagcagaaacgaatctgactagtatccatgaggtcttgggttcgatccctggcctcgctcagtgggttaaggatccagtattgccaccagctgtggtgtaggtcacagacacgtcttggatctggtgttgctgtggctgtggctgtggtgtaggccgcagctacagctccaattcaacccctagcctgggaacctccatatgccatgggtacggtccttaaaagacataaataaataaatgaaaaaagaagtacccttctttgattacagaatgtgatatactggccatagatgactcctcttttaagggaaattgttttgtgccagaagcgaaaagtattgtttgaacccttgctccccaacctaggggatgtaggcgtgtctgtcccttctctgtgcgtctgttttctcatctgtgaagtgcaaggtccctcccatttccactccatcctgcctgggcctgagtctgagggtagagttgtgaactgggctcctatagcagtctgactgggggactcagaaggcttcatggaggaggggatgtgaccagacctttccagatgggcttcccctgcctcccagggatctggcatatcagcctgcacagccactcacccttctcttccttctcactgaagacaggctgaaaaactaacctgccgggggaggcaggcagccccacacttcagaatttataaatcctcctctgctcaggctcaggcccagtccatcctgggaggtgctggaggtcattttatgaaccaaccaccttcggctttcggggcgtagggatggggcaggatgccacagaatcaccagcccactcacgagcccccctgaacccttcccagggtgacagaaaagaggaaatggagcacaattccggccccaagacaaagaaactcggccaagcaaagagaagggaaacagcttcctgagtcaggggacttggaatctgctagggccacagggaaccttccccccatcatggtgaggctgaggtgtggactcaagcaactgagaagataaggacaggtgggtccgcccccacccagctcagcccagaagcatttctttccaaagcgcccgtggaaaggagtggtttgcagtgaagaacatttttcaaaaaaatcgaagtctaatactaataatataaccagataaaagaaaggccaagaaagtgccatataaatccaaagacacggttccacaggccacgtggccacaggcacatttttcccctcctgggcctcacgccccgtgtgggcactgacggagtcgaagtggaacattcccaggacccacctgggctcggtggctgtgaagagcctgttgttacttgctctgcaaacctggctgatgaacatgcagccttcagagcgcaaggtcacctcctccaagatctgcctcctggcacaagtggattctcacagccctggtgtggcctgctggtttcacggcacctagagcgcaggttcttggacatatgtccatctcactctctgcacgcacattctcaagggcagcagggaagtctgctttaggtcaaggtccctggtggtcctcaccacagggtctggtagagaggaggtcttgaggatcagtaggctggtgacagatggacagatggacttgctggggctactgtaataaagcaccacaaagtgggtggcttaacacagcagaagtttatcctcttatacttctggaggccagaagtccaaagtcaaggtgttagcagagctggttccttctgaaggtcatgaaaaggaattctacaggcttctctcctggcttctggtggttgccagccacccttggcattccttggggcagcataacccaacaccgtctgcatcatcacacagtgttctccgtgtgtgtcagcctccaaatttccctctctttagaaggacaacagtcactggattggagcccacccgaatccagcatgacctcatcttaatttgagtcatctgacaagaatctatttccaaaaaaactcatattcataagcactggggattcggacgtgaacccattttttttttttggaagacacaattctacccactagagaccgtttcccaaatgcctattggctgggagcgtgtaaacactagcagaaccacctgtgagggtggaaacgctgcatataattacggagttgaaagcgaaagtttggaggcaggcggggaggtaggggtggtcttgagaaagaggaaaacatcttagagcatctctacttggccaggattataggaagaagagaaatgcctccccgggacaggcatctgtgggatgtcccgccgaaatgctgccggtctgtcaatactcagctctgggcatcacagagccatgaatgggtaagcttcctcccaagaggagcaggatgtgaaagaagagggggccctggggcagctggaaccaagaacctatggaagcacagagctgggcaccagattgcagtgggtcaaggaatgaaggtcaggtgagaaagtgacgtgcaaggacctctcgccagcagcttgccttgggaagggctggagggagggtgccagctagagacacatggagcaaaaaggaaatacccttgagtacactgctgataatgaaaagcccttaatgagacagagccgaggagaggagggtttgaagattcagaggagggagaggatgggggctgaagagcatctcttggcggggagatgggggtgccaccaagacaggctgaaagtgctccccctttttgaaaggagcaggagacagaatgggtgggttggcaagtctggggataaagcgggtaggtgacaggctccaatccagagcagctgaagcgaggagggagaagggggccaggaggcagagaagctggagagctgtgcagaatctcatcaccaggaaccttgaacttgcacctgaaaaatgggcatttcatcctgaaagtactagagaatccttgaatgccactaggcaaagaaagttacacgatttgctttttagaagacttccttggctgaaggatgagggagcccagccaggaggctgctggccaatgtcagaggaaagagtagagacctaaccccacaggtagagctggaagacaagaaagaagtggcatcttgagacatagggttacatctatcttactttctttctttcatttttttttttttttttgctttttagggccacacccacagcacatgcaagttcccaggctaggggttgaatcgaaactgtagctgccagcccacgccacagccacaacaatgccaaagccgcatcttcgacctacactacagctcacggcaacgccagatacttaacccaccgagcaaggctggggatcgaacccgcaacctcaaggttactagtcggattcctgagccacaataggaactaccgggtcacgtctttgaaaatctgcttcagtgttactttagagaaactgtcctggatttaaaattactttccttttgtagttatctatctttcaattttatttcttcttctaccagagtgtcaactctgtgggcagatatttttgtgcgtttggtacctgtgtggaaacatctgtctattacagcccctggtgctccgtacagctttgtaggctaaaatgcatgcctggtacagtgcttggcacctgtgtgttcaataaacatgaactatggtgataacaacagcaagaataacagtgagcaatgggatgaagggagtgaggcagaaatgagactagtttggtgggactcaaagtgtggactgagcaaccggtagcatcagcatcacctgggagcttgttaagaaatgcagagcagcaggcccacagcccaggaacctgtgtctgcatgaggtctgcaggtggtctgggaatggggctggttcccaggtttctggttgaaggaggagagtgggtggcatcgctgctgactgacatggagcggcggggctgagaggagggggagtcagtgagttctgctcaagaggtgctgagtttgaagaacctgcagaagtcaattcagcaatgttgtcccagagagagagcccggggagagcccagtttcggagctgccagcccagcgtgcaggcaggagtcggcaggtcttctgtgtgccaagggaaaggagcacggagagcagaatggggcctccttaatgggcaccgccttgaaatctgaggggcagggccgagaggcaggaggagaaacaagaacaaaagttgttgctgggagaaaccccatctgaattctcagctcagctccacccgtgaccgcctctggccctgcttcccctggaagagggaaggccacggacaattgctcgggcaaggttgctgctgtttgagaatcccaaggagcgggactgtcaggcaaacagaggggtggcaacagagaggggtcccgtttccagctgtacctccaactccggcaactccctgcgtgcctggttgattcccgcccccttcggatgacaaggtggggccggggtctctgaccatgttgcctgccagctctctgggctcacccctcatgtccggccacagactctaggggaagaccccagcagagcataatggcagctgccttcagagcacgtgaggaggctccagaggccagaccaagaggtgagggaagggcacgcagggtaggaagccaggattcccgagccaacaggtgtgctctacctggctcccatcagtacagctgagagtcaaggtctaaagaagcctctctgtccctcagccaaaaagggaggcccaggaaccagcaagggccactctctgcatttatcaggtcctagtctggcgagagggacacgtgctgactgcagaccgcagctactgcagttgtgttcagtgggctggggctggcagagtggggctgcacaggtgtcccccggaggaagtcccagctcctccctgccccatcacctgttgtattttgctttaccaccctcccatttttgccatttgtgcttggccttgtcacagcaacccctcctggtgcaggtagtttcccagggcctctaaaatcaaggtgcttcccctagaacagttctgatttatacttgttatggctcaatgttttagtacctcctttcactttcaaaggtgtgcaggtgtggaggacaaatcatgttgcctgtcaccctacataaaaacggttcaataaaatagagttcgatgaagtccccttcaagacgcctctcggcttggaccctccaggagtcagggcttgtgtttaccaacagccggtgccgtgacctccccctctccagcatccttcctgctactgcctgtggtacaagaggtggtaaaagcctttctgccacccctcccctaacctgtccccttcagtgcctgttgctgggatcatctcagctccccctgcctccctgtgtaggctgggaggaattaaaagtctaagaatttactggaaaatcctaaggttgttttgtcttgggcttttttcccccctcactagatttttttcttgtaacaagttgacgagcataaaagaccttccaagaattaatctctaatcatgagagatttccttcctagtggaaagctaaaaataacaaagacaacaacaacaacaccccaaaacctcttaactgagcccacaatggagatggcttttcctctgcctgttctttgtcttttgccatttttttttttttttttaagggccgcatcagcggcatgtggaggttcccaggctaggggtctaattggagcgacagctgccggtctacaccacagaacagcaacgccagatccgagccacgtctgcgacctataccacagctcacggcaatgccagatccttaaccccctgagccaggccagggctcgaacccgcaacctcatggttcctagtcggatttgttctgctgcgccacgatgggaactcctttgcccgttcttggaaagagccaggccccagttcaaatgccagtggcgccccacccccaccccccactttcttgctgcgaagccctggctcagtcacttcacattccgagcctcagtttactcatctgttaaagagggatgataattccttactccttgaattgttgacaagatgaacagtctgtaaagctcctggtaggtacttgggaaaaaagcaacttgtattattatcgctggtccctaagagacaagcactgtccccacctcatcacagtgacaggaggcagtatgcccagagattagagcttgcacttgagcaagacaggcctgggaactgactaaatgcgtgaccttgggcaagtcactggaccttctaggacttgctttttctcctctgtaaaatgagaataacagtgactcaccatcggtgagatgacgcacatcaagcttggcatgacccctgatgttgcagcaagtgcccaatagatggtagtttctcaattcccaatagtgattattgcagaactctccacctcacaggctctggcaccacctgctctgtatctccagggtccactatgttcccctgtccccaaaacaacagcccttcctgtgcagggggcatttacaaatccacctttccccttccgctggagtctgagctgcagcccgtgagtcaggctgggtctccacgtgcggaggaggaggtggaggaggaggagtctggtaactccccaaggggggctcagctgggactggaagctgggtttgggtgcagccaagaatttcttcagccccttcctgtcccacagggagcctgattcagagttgaagggaattacgtgtttgtttatttattcattaaataaatatttaacaccagggagttcccatcctggctcagcggttagcaaacccaactagcatccatgaagacatggattccatccttggcctcgctcagtggtttaaggatctggcgttcctgtgagctgtggtgtaggttgcagatgcagctcagatcccgagttgctgtagctgtggtataggccagtggctacagctccaataagacccctagcctgggaacctccatatgctgcaggtgtggccttaaaaagacaaaagaagacccctcccccccaaaacttaacaccaatgttgatacctaccacgtgccaggcaccattcaggctgctaggtcaataaggattagcctattctgtgcctttctcacagagctagtgggaagtggagcccttcctggtgggaagctgagcccggacagcaacacttctacatcctgaagccaaggtgagtgtcctgtgacagcaatgagtcagcccctctctgggctccatggacttctggaagactcggagagcaagctcacctgcctccttgcccgtgtggctacaggaacatgtttaccacccagggtcactctctctcaagcatggccccaatcttctgagctgcctcactttccagatgagaaaactgaggcaccaaggcagggaagtaacttatccagggccacttggtgatgaggtgaagaggccagggctagtacccaggtatctggcatctctctaggctgagacgcctattagccacagcaccagaaatcaagagcttagagacggggcgaagggctgcagtcaatggtcttcttctagagttttcttattaatgcccaggaaaacctctgatgggacatagaaatgccactgggaaaaggggagcatcgtgtgtttactggagacaagtgaggcacccaattcaaaaagaagatccctctcaaacataaaatagttcagcaatggagtaaaaaacacctaaatatgtgttccacttacaaagcatcctatgggctgtgatgaagaatgtggtttggaaactccgattccaccccattgcctctgccttcacctcccaccccagtgtttagcaccaggagctcccagcacatatcacctacccttttcctggctgctgtcttcttcaatgagcttctgcttttgattcccctagagaggctggcagtttcgggcacctttttgttcctctgcttagcagttggggcggagaagaagtggctttggggtttttcttctctgggtgtggtttcctagccctcacaaaggaaagcctacagcctgctctgtctgcaccaccagcctggttgcctcagctggcagagctgattagcatgcgaggtgcagaagggaacagcctgcctggggtactcaggatactgttctactaaatgtttcctgctctccaccttcatagtaggatttcatttcctggtccccttgcagttgagtagggccatgtgactagtctgaccaataagatgtgagttggcccaagtatttaattgctggtcaaagaccctccagggctctctttctctgtgccatgaagtatattcaaggacgtaactgctccatcagcctggctccttgaatgaggagcacagcccctagctgacccacggggctcatgttaattagagtaagacataaaccgttatgggtttggccccaaagatttaggggctgtttgttactgtagcataacctacaccatcctgactgatacactgcccatctcacacagagtgagatattccctagttaagtctaccatcttcccaatgttgctctttcagccagaagccatttcacttcctctgagctccccttggcctcctgtcacacttctgttctgcactctgacttctacttttagtcccttatatataattacatacagccaatttcacattgtgagcgcctgaagagcaggaatctgtaccttatattatgatgatgataataataataataataaacagaggcagcaaatgctactatttattgaatgctgggctgggttctaagcacttgacattcattcagttctcactaagctctgagaggtcagtactggaactacccccactttacagatgaggaagcatctcagtttggttcagctgaaattgaacccctaataatatatatatatatatatatatatatatatatatatatgcattttttttttttttggtcttttcctagggccacacccgcagcatatggaggtccccaggctagggatctaatcagaactatagctgctggcctacaccacagccacagcaacaccagatctgcaacctacaccacagctcacggcaactccagatccttaaaccactgaatgaaaccagggatcaaaccggcaacttcatggttcctggtcggatttgttaaccactgagccacgacgggaactcttaatatttttttaataaatatagttcaacttaagtcattccctctataatcctagtcacttatttttcacatttaaaacattcccagaaggggtctataggctcccccagatgccaaaagagtccatggcacaataaaggttaaggtcccctgtagaagcagataccagggttacagtgacagggttctgtcccctgttctcctggaacccagagtttctggctggtggagggtaagggaccctacaccaaattcatgccacagtggggagtgaacaggagctactttattgtattcacatagcataaacataaatatcgtaggtttggcatatggaactccctgtcatgaatattttgatttcagcagtgtcagcccaagtataacattcatcacagtaaagaagtcacttgtttccccagtaaaaaaacaaaacaagggcgttcccttcatggctcagcggttaacaaacctgactaggatccgtgaggatgcaggttcgatccctagccccactcagtgggttaaggaactggcgtgtaggccggcagctgtagctccgattcaacccctagcctgggaacgtccataagtcgcaagagtggccctaaaaggcaaaaaacaaaacaaaacaaaacaattcctaacatccagtgtgctaattagaaaagcatcagctcttgatcacaaattgggataacaggacagcagccatctctggtcagtcccactcccagacgatgcatccttgagggcagatgggccgaccacccacgatgagacttgctttcttagcttctgagcactggcttggtccaagtagcactcacataatctcccatattgtatatgctgaagttttatactttattgaaccagaatttactttaaattccaggcatccaaacatatacactgaatccaggtgaatccaagcagaactctctggatttcagaaatcctgggtgattacaagactcagggataaggtagcagagccaatgctctgtgcctccttgccagctggccagtagtgagggctgagccccaggacaaccgggtggcagtctggcactgccctggtgggctggatgaccttccgcaaattacaggctcagttttcgtatcctccaaatatggagccatactagatccaagtccaggcaagaaacaatcacaaggcacccgcgctacgcctagtactgtggggaaaacagaaattacacaaactccataaggagcttacattctagttggggagccaggcctggaaacaatttaactattgtgcacgacagaaagaagtaagtatgaaggtggtggaagccccctcttgtgctctgggaccacagaggaagcacgaagccaggctgcataggcctgcgcagctcggtttcaaagaggaaggggctatgcttgaactgggcttcagagggtgagtaggagtctgatgggtgaggaagggcatacaggtggaagggcaaggatctgcaaactcggggtctggaatgggaagccccacccccagcccagatcccagcccaggggttccagtcctgctctctccacacatccgctgctttggaatctggaagagtcctggaaacctgtattttgaacaagctcccacagtcattctcacaagcaggcagtgagtgttatagattgagaaaaatgaatgaacaaatgaatgaatgaatacaaaaatgaacctgagaagttcctgttgtggctcagcagaaacgaatccgactagcatccacaaggacgcaggttcaatccctggacttgctcagtgggttaaggatctggcattgctgtgagctgtggtataggctgcaggctcagcttggatcccacgttgctgtggctgtggtggaggctttcagctgtatctctgactcaacccctagcctgggaacttccatatgctgagggtgcagccctaaaaagacaaaaaaaaaaaaaaaaaaaagaacttgacttccggtaagtccctttctctcttaggatgtccacactacattaaggagctaaagagcttcagttgtggctcagcagtatccatgaggatgcaggttcgattctgggcctcgcccagtgggttaaaggatccagtgttgctgtgagctgcagtgtaggtcacagacaaggctcagatcctgtgctgctgtggctgcagctccgatttgactcctagcctgggaacttccataggccacacctgcggcccttaaaaaagacaaaaatgaaaaaataaaaagcaaaataaaagtgctgaattggcctggtggctttcaaactgtgttccagaaaaaccccagaatctccctgaagtccctcagggacacagaggaactggggaggctgagagagccggactctgggccccatccacccttctcagattacctctccttttatctctttgctcttttttttgcaataaagggttcttggctacaaagaactcttaaagccactgaattgaataatcctagaattcccaaggagtcagagttcccattgtggctcagtggttaacaaatctgactagcatccgtgaggacgcgggtttgatccctggcctcactcagtaggttaaggatctggcgttgccgtgagctgtggtgtaggtcgcagacgcggctccgatgctgtggctgtggccagcagctacagctcctattcaacccctagcctgggaacctccatataccaccagtgcggccctagaagacaaaaaaaaaagaatccccaaggagaaatttaaaaatttcttgagggcagcagcttacctttggcaagtatgaagagagcataagggtctttttcagaagcaagttatttaatcatcacattttaaaaaccttttgctgtggcccagaaattagtgagtgaaggaaaaaagcaatgtggtataataatgcaagggaatattatgcaacctttaaagaacacttttgaggaatggttaatacaatggaaaataaagtgaggaagtcagatacaaaatttcatacagactgtgatttacggtatggattttttttttttttttttttggctacacacatgaaagttcccaggccaggaattgaacctgccacagcagtgacctgagccacagcactgacaactctggatccttaaccccctgcaccagcgctatggatcttatacatcaaaattattggacatggatgttagtaggccggtagctgcagctccgatttggacccctagcctgggaacctccatatgcctcggatgcagccctaaaaaacaaaacaaaacaaaacaaaaaaaagaagaatgcaattctgacatgtttcagcacagataaaggttgaaaacattacgctaagtgaaataagccagacacaaaaggacaaatagtgtgtgattttactgagatcaagcacccagagttgtcacattcaccgagacagaaagtagaagagcggttacgggggtgggggggatgggggtgggcagtgggaaattactgcttaagcagcacagagcttctgtctgggatgatggaaaaattcagatggttgacactggggatggctgcccaacgtgtgaatgtgcttagtggtaccgaactatgccctcaaaaagcattagaatggtttatgctatgtatcttttaccacaataaaaggggaaaaaaaagccagaactaggtgcataggttatagtggtgaatactatgcgacaagcttgtgggcagcgtggtcactttattctttgcatttctctgcatttttcaaacgtcctatgatgagcatacatttctttttaaaaccagacagaagagcgagttaattaaacaaatctcgtggttctctgacacttttgcccaaatgcgttactgtcttttgcgtaaatgtaaggtgtgttccctgtccttcgttaataaaaggagccgagcccaaggatgccaacgaaaggatacaccgaggtgctcaagtcaacgacaggcacagcggccctcctttctaagactcgttgctctcgtctatatttaataagttccaaataaaaacagaacccaaacaaatcctctaatgaacttcctaagaagctgtctggcttggaaaagctcaaaggcgaactgaagagaaagggggaacagctgctgtgtttttagggcattaactcactgcagctgggacagtgcctttgtcagtagatttctatcccttcttgcttctgggaaatgttcttgggcagaatgaattcagaaaccaggagaggctccccagtggtattccctgccaatccatctgctccagtaccctctccccaccccagaaacatgctgaacaaagatttaaagactcttggtgtgaagggcagccacgtgtctgcctgccagggtgccctccaccccaggccgcctgggtccacttgcccggctcctgggccctctgctcaggggtggcacaagggcagaaggtagctgccacgataagcagaccggggctacccctggagtggcccctccctggctacgtgacctctgcctttttcaaatgttctatgatgagcatacgtttctttttaaaaccagacagaagagcgagtaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatatggaccataccaccttcccctggccccaggttctcacctatgtgactgagggaggtggactggggcacctcttagatctctgccagctcacacatcctatgattgcatcatctcaaaaagaaaaagaaaaaccaacaatacctaaaccaaactaaaccctaaaaccaaaaccaaaagcagggtgccttctaggaatctaggccaggttcttacgtttgggggggccttggggtccctatctacaaaatgaggcacggagtttccaccatggcacagtgaaaatgaatttgactagtaaccacgaggacgcaagttcaatccatggcctcgctcagtgggttaaggatctggggttgctgtaagctgtggtgtaggtcgaagacgaggctcggatctggcgttgctgtggctgtggtgtaggccagtgcctagagctccaattggacccctagcctgggaatttccacatgccacgggtgtggcactaaaaagaccaaaaaaaaaaaaaagggaaaagaaaaaatttggcacaaccttccagctcgttccatgtccaacatctgtaattcctgaaaggaaggccccatcctccccttgccctccaccacgtcctctacctcaggccaggctcacaaacaggaaatatgacattcgagagcagcagaagcactgcttgcttctcgacagcataggggccgatggagaacaaagagtttctgagcttttccagcaacaaccagggctccatgcccaagaccttccccaagcagtgcaggcagaggacactgctgggatgggctggcctcccatgccatccccgccccggtgtgttcccaggggcccccggcagcgcagaatcagcagataagctgtctggccgtaattacacgctgatgcttgaccaaaggtggtaaaaccctaaacaggcggaaggcagggtgcaggattcctggactccagtgcaggagtggagtgaccctagagaggccctacccctctctgggcctgagtttccccatctatttttttttttttttttttttttttgtgtgagtgcgtgtgtgtgtgtgtgtatgtccccctctatttgaatgaaagggctagaatggggcctaatggcagctctttgcttgctccgaggtcttcggtttttcttttttcattccatttttttttttttttttatggccacacccacggcatatggaagttcccaggctaggggttgaattggagctacagctgccggcctacaccacagccacagcaacaccagaccccagctgccagatccctgaccatagcggatccttaaccttacaccacagcggattcttaacccactgagtgaggccagggatcaaacccgcaccctcatggatcctagtcgggtttgttacagctgagccacgacgggaacgcctgatgtcttctttctgaaggcagtgtgtggccttgatgaaaggccccatcatcttgcctgtgtctgcgtcccaaatctctccctcaccacgtgaccctgagaaactgctaaatctttctgtgtttcgtttgctcatttgtaaaactggggttgctgggtgatgaaaaggcagagctcctgtaaagctcctaggacagcttctggagttagcgcccaggaagcgtgcgctcttgctgttttatgatttctctggtttcagaatcgctccccttgccctgtttgccatctgaagaaggagcaagcatggcccagagagccatactggccctgcagtccacgtctagccctctccctccaagaaagcacatgtgaatcttggtcagccaagcacagtgggaagagggaactatgggagaaaaggcagaaaatcctacgatgctgccccacagcagatgggctcgggtgtcagctgctcccaggggttgctgggcactagagaaggcctccagctgcacccagagtcagtagcggagggagggtcctgggctcatctccagcttgatccccgaatggggaggagaatgaccccgtgggaaggagggtgatgagatgcagaagatgcagccgggtttatctctgttcctactttgccgggaccattcagggaagaggaggccacattcagtcatctcagccccgaggggaacagggaacagagaggggtgaggatgacagcactggtggtctctcccctggggacatggaggtgtggcctccctctgccacagggagggtcccaaacctgcctgtcctcagtgttctcacctgccaagggaggagacgcaaatgcctgtttccaccaggcgctctagggtctcaaattgtggctgcggacggatgcatcgaggaggcacagaaattgagagtgttttactaaaggaccagtccacaggggattagaaataaaggaagaaaggcctgatcttctaccacactgtcctaggacataaagcatgatgcgggagacaggcaggacccctgttccgcctcctggggctaccccgcttggctccagtgagctctgtggtccaggtggaattgtgggctcccatctggctgggacgactcacccagacagactgccctcctgatccgagagcatttcactcggcagcaaattcaacccacctcaaaatatcagctgcccctgatcaggcagggcctggctccctctctgccaagccccacagggctgggctgggatcagtcatggcagctcaagggaagtcacgctgcacccagaggtaaaagctgtcctggcagagaaagagaaaactgatggtcctaagaacaagcacactggctttcacccttgaggacgctcagttgagaatctcggtttgggagttcccatcgtggttgtagatggctctggtgtaggccagtggctacagctccaattagacccctagccagggaacctccatatgccgtgagtgcggccctaaaaagacaacaaaaagaatctctgtttggctgccctgtgtggcaggtatgcatttatcaggtatagagacattttacagatgaagggagcccaggggatctttgctcaaactcttttttttttttagctttttagggccacacccgtggcatatggaggttccaaggctaggagtcgaatcagagttttagctgctgccctatgccacagccacagcaatgctaaatccgagccacatctgagacctacaccacagctcacgccaaagctggatccttaacccactgggcgatgccagggatcaaacctgcaacctcagggttcctagtgagattcatctccactgagccacgatgggaactcccaaactcttttcttttacagataaagaggctcaaggaaaggagcaccttgtcgcagaagcaggatttgaaccctccaaggctcctagccccatctgcattcagcctgccaatccacggttaggagggccaactgcacacatgcgcagtgtgggatgtggtgaggaaccacacaggaaaagccctcagttctcacagagctcacattctaaacaaacaacaaaatcagtcattataattaacaaatcattaaagacataatttcaggtgggggagagggttataaagcaaatttaaaacctggcgtgtttgagagtgttttggggtgggggcagctgctgtttgggaatggcctctttgcactggatcctctcaggtcctcccaagccagtagaatgctggagctggctcctgctggcttgcaagggccacgtctcattaggaatttggcgagcaagttgttcaccacagccattattaaaaattaaattacataaacttagaactaaatgaattatagtacgacggaaggtaatcatcaaaagtcatcactccctcgggttcccaggtggcctagcagttaagggtttggtttgtccctgctgtggctcaggttcgatcccagacctgggaactttccaaggccacaggcacgtgaccaaaaagaaaaagaaaaaaaaacttcattaatttcctctttgtatgaccacatactatactcttgaagttgtttatatctattgaatctagacgtaatagatactcccagttcctccagtagtagctagaaactggtcatggtagaaatatgtctactatggaaactggcaaataccctctacgagggctttcacttttcaaagagctggtggtgaaatatttaccagcacagccttcagctctaatccaggccttctatgcctgtgggagtctgggttcttccaaggagagggtgtggtggtatagtctaactctcctggggctgggggcgaggggaggtggtgggcagtgcctccagccctgtcctcttcttcttctgtgtgtgtgtgtgtgtgtgtgtgtgtgtgtgtgtgtgtgtgtgtgtgtgtgtgtgtgtgtgcttttcagggctactccctggaaagttctcaggctacatgttaaatcgtagctgcagctgccggcctataccacagctcatgacaacactggatccttaacccactgagtgaggccaggggtcaaacctgagtcctcatggatactagtcgggttccttactgctaagccataatgggaactcgggcagtcagattcttaacccactgcaccacagcagggaccttcttcaaaagtgtttttcaacagggatctgtaagagggtgattcattccttcctttgttatttatttttgataaatgaaatcctatcataagcataccaatataaatttaaaggaaccctgccgagaatctctttgtataaatgcctgcagtcacttctgagttcccctagattttcataggtggagggacttccttagagaatataactgttctcattaacagcagactgaagttactattacctctactaataacaatgacaactgtagctgtcttttactggcaccacctcaggcactaggcacatatattatctctaaagtctacatcaacccattttacacataagaacgttgaggttcaagggttcaataacttgacctgaggccagcctgctgctctgaaagtttcacagaaggctttttccttctgtagcgacagccctgcgactctccttagacctgcaggattctgtggtcctacaggaccccccatctctggtggtttgggagaatttcgtcacgtctcagcttagtgtaaggaactcccttccatcagcagaacagaatgagccagacgctccccctggactttcttttttttttttttttttttgtctttttgctacgtctttgggtcgctcccgaggcatatggaggttcccaggctaggggtccaattggagctgtagccactggcctacgccagagccatagcaacgcaggatccgagccacgtctgcgacctacaccacagctcacggcaatgccagatccttaacccactgagcaaagccagggattgaacccgcaacctcatggttcctagttggattcgttatccgctgagccacgatgggaactcctccccctggactttcacctgcaatgcaggaaagtgacccaggcctggtcacttagcagcttcccacccaaaagaagtagcactcaggttctgataccagtgaaatgttaacagcggctccagtgccagcaagagctagaattaactcctgttgggagaccctaactgtgttaggtctgttgcctgacctctcctggttctgagcagcttggttttcaagctcccccaggaataccatgagcaacaaccaaaaaatccttccaaggcacatacctcttctgcctcggtgagctagaatctccatcggttgcttgtaaccacaatttctgacccgtacctcatctcaagcgcttctcaatatatcagccgcaaacattcgctgagcctttcatgccagagaaggagctcctaagcactcaattagtttgcacagaggaatagtaatcgtgcctttctgtgcacagctctggcataacctatgaaaacggagtttgccacacaaaatagcaatctgcaaacaaccacagctcaactgagagcaaatccaggcccagtccctgctccccgggagccatattccccctaaagaaaaccccttccttgattttgtcaacggtcttgtctttccccacagatgccaggcaagttcctcttggggacagctggccggccacttgaggacttgcgatttccctgacgtaggagaaaggacagctgggtttctgcacacagatgctgccaagcccaacgtcacccttctgggcagctgacccattgccccgggcttgctccctcccctgtgcccctccagacaccagggccatctggattctggaacagccatggggaagatcaggatgactggttctcaggacccctttcctttgcctgaaacgctcttcctttttcaccctctacatcctgcgggcctcagtttaaagatcacttcctcagggaagccctccctgaccacttccccagacaagttcagggccccaggaccctgccctgtttatctcctccatgtctctgtctgtgcagttcattgtttactgactatctccccagctgaattctagcctctgcacaggaagggattgcacctctgttcaccgaatctcaggttatctagcacagcatgtagttccataaatcctgaacgctttaaagatgagtgaaggacattctggcggctcagtgagcgctgaatgagtatctgatttaaagcatgcatctcagcaacaggtgcatcttttaggaccaccgttttctggtgcccaaactcacaagggcagggtgaaaatttagccatccctacttctccccgggtcgtttttagtttgaaggtttgtttcctgtgggttgggactggcccgatttttgtttaacagcagctattgctcagagaggagtttgctagatgccagccttataccacctggttgatggggaaactgaggcccctaccactggctgcaccagcaccggcggggcgagaccagctctctttcagcccagagctcatttcagggtccttcgccccacatggggccaagtccagggcatgcgaagcaaggctcgggaagataagggcacccagacggggatggagtttgaaacttttattaagaacgaatcaagagggaattcccttcatggctcagtggttaacgaacccgactaggatccataaggacaagggtttgatccctggcctcgctcagtgggttaaggatccagcattgccgtgtaggtcacagaggcggctcccatctgtgttgctgtggtgttgctgtggctgagatgtagtctgacagctacagctccgattcgacccctacccggggaacttccacatgccatgggtgcagccctaaaaagcagaagaaaaaaagaagaagaaatcaagagacctggcctctctctctgcccagcctcttccagctgctaccttccactctctccggctagtttcaggttgagcaaggccaggcaggagccctctcgggggctgagcatggatctgggccccagcagcgcccccaaccttcagattcaccttcactctccttgctcagggcccaccagggtctccaagccaaactatgtttgaagtcaagaccaggctttcatgctttggttctgccacttcactcttgagagatggtggccaaacaattaaaacgctgagcctcaatttccctgcctgtaaagtgaggaggcggggggataattcctgctttgctgacttcatagggcttttgtgaggctcaggcgaggtagatatatgtactcactcgtctaactgtccactagcttagagaactctaacaacaactctaggagttctggcagtgggttgagaatccgactgcagctgctcaggtcactacagtggcacgagttcgatccctggccctgtgcagtgggctaaagatctagatagagttgcggcagtgatggcataggttgcagctgtggcttggattcaatccctggcccgagaacttccatatgacgtggtgcagccgtaagggaaaaaaaaaaaaaaaaaaaagatactgtttttctggtcccattagggtcttgcgatcaacgtgtagccagcccatgtcctccagggcccaatcctccacccaacctctcagccaggctctcctcttgaccacatccttctagaaatcctttctgcctctgccttcctggatgtgctccctctgggctctcctccatctcaggtcactcattctcccagttaggacctggcccacctggcagctccgtgctttttcctgccattcacgtcagccaaccacacagggcctgggacaggaactgcagggaacacataccaacactcagatccctggataaggcttgcgtgcgcattccctggggcacaaaacatgcgcacaaagcattgtgtccccaccccactgccctcaccacccctcctttgctggggcatagggcagaacccacagcagacggaaattcccaggctaggggtctaattggagctacaactgccggcctacatcacagccacagcaacgccagatccaagccacatccacgaagtacagcacagctcacagcaacgccggatccttaacccactgcgcgaggccagggattgaaccagcaacctcatggatacttgtcagattcatttccactgtaccccgacaggaactccaccactcctcctttaagagactctatttggcaataaagccagagccaaggctctggcaagagttgcagccaggtctgatcataggcagccaaggtctgtggccctccaagccgggctgggacaagccaagcagatcagctcctcggctggagatttcaatgacatatttttaggtcagcctctctttagaattgcaaggacttttataaataattctgggttaagtatattccacatgatgacccttctgccttcagtccacagtccaaatctacatcactctctggtgtcccagactgacccacctggcttccctctctcaagactaaggctgaagcttttatcagcagaccttgcagcccagggcagggggttgggcaggggggaaacgactttgccccagttgcccttgggaggccacttacccacaagtgtgggttaagtaaagggcactgcggtcacatgcccagtgtgccatctggcttcagcagccaccgtcaaagagggaagaaaaagtgacatgcaacagaatgtaaccggggcatggcctgcaggatgcccagggacctggggggcagaggggtgccaaattcatggggggcttctcagagagggtggtgattaagatgggccttgaaggatgtgtaggagtctgtgggagggtttggggaggaggtgggagggtgtcctgggcatggggaaaagtccagagccatcgaaccaggagagggtttcaggaattgcagcagttccctcaggctggagcagaagttccaaaggatggagtggtgagggtggtgagggcttcagagggctgtctgtatgggaccttggaggtcacccaaaggaatgtgtgctttatcctgagagcagagggagccttggaaaagatggaaaactccaatcaattaggtgtttggaaatgagacttaggctgcagggagagggtgtataggaacaaagaacagggagcatgcagcagcaggggctgggctgaagagggctgcccaccagcacagcaggggcaggggggctggaaggaaagggtctctttttttttagggccacacctgcggcatatggaggttcccaggctaggggtcgacttggagctgtagccactagtctacaccacagccatagcaatgccagatccttaaccccctgagcaaggccagggatcgaactcatgtcctcatggatgttaattgggtttgttaactgctgagccatgacaggaactcctaaagggacactttggagagctggtaaaggggtgggattgactgaactagattagactggaggggaatgtttgttatgcagcataactgcagccaaagctaacagaggggccacatgagcaaatatatagagacagaaaggccactgccatgcttgaagaagcggaacgatggtgctgatggtaccaaagagcaggctgtgtgatgggcattagtttggagagagaaagataggtggggacctgcacgagggagtttctaacaaatatatgaagttgattggattgttgttcccaagtatctattctgggccaataggcagagcttatcgcagtcccattgactttagactcagtcacatgaccagctttgaccaatggaatatggatagaagtgaccatgtgccaattcagagatttaattttttttttttttttttttgtcttttgtcttttgttgttgttgttgttgctatttcttgggctgctcccgcggcatatggaggttcccaggctaggggttgaatcggagctgtagccaccggcctacgccagacccacagcaacgcgggatccgagccgcgtctgcaacctacatacaccacagctcacggcaacgctggatcgttaacccactgagcaagggcagggaccgaacccgcaacctcatggttcctagtcagattcgttaaccactgcgccacgacgggaattccttattttttttatttttttgtctttttgtctttttagggtctcacccacggcatatggaggttcccaggctaggggtccaatcagaactgcagccgccagcctatactagaggcacagtggatccaagctgcatctgtgacactggatcgtcaacccactgagcaaggccagggatcgaacctgcaaactcatagttcctgatcagactcgtttccactgtgccacaacaggaactccctcagagattttatgttatttatttatttatttatttggtcatgtagcagtttgatgtgggatctcagttgccagaacagggattgaacctgggctgcatcagtgaaagcaccccaagtcccaaccactagactaccagggaactctcagaaactttaagaagcattgaattatctctttcttcctccagctctcagcatcaaaatgacacattctaggtagaaggagcagcttcagcctgggtcctgggaggagaagatacatgctgcagatattctatcctgctgccacctggagcagatctacaaaaccatgcagttgcaactgccttctggctgacaagcagtgtgagcaataaataaacctttgtggtcgtaaactaagatgggggggatgtttgttatgcagcataagctaactgatacacactatatatgtgagatgataaggatgcagatggtgaagaacatcacatgtcacgattagttgttgtacacatggtgagtcaacaaagaattttgtaattgatgaaccttctccacctttcctttaaagccaaccctctccactcccttctgctcctcctagccccttgctctatcagccaccccttccctcgcatggactgaatccttcccctgaaactatatctcacttgtctcttccatcctaaaatccttttctttactctgtcttcctccaactctagctcagtctcttcctcgaccatctcaaacaaacttcttcttcttcttttttttttttttttgtctttttagggccacacttatggcatatagaggttcccagtgtgtgacctacaccacagctcatggcaacgccggatgcttaagccactgagcaagaccagggatccaacccatgtcctcatggatgctagttgggtttgttaaccactgagccacaatgggaacttcttcaaacaaacttcttaaacgagttgattctcctcattatctccacttctttctccctcacctccaagcaatctagtttaccttccctccaccccaccaaaaccattcccagtatatttcagcaatctaatagtccagtgcaatccagtccttatcttcctagactgttccacatcatttagcttggaactaaattcattttctccctgcccaacctcaaatattcttctttccatggagttcctgtcatggcttggtggtaacaaacacgactagtattcttaaggactccggttccatccctggcctcgatcagtgggttaaggatccggcattgctgtgagctgtggtgtaggttacagactcggctcagatccctcgttgctgtggctctggtgtaggctggcagctgcagctccagtaagacccccagcctgggaacgtccatatgccacagttgcggccctaaaaagaaaaagaaaaaaaaaattcctctttccatattctctcagctagtggcaccatcattcatccagtgactcatgacagaaagccagcatgacacagtgaattctgctctgtagttgtccagtctgcggtgcctttgagacatccaagaggagatgtcccaagggcagcagctaaacatgtgaattgggggctgacaacagagatctgaagtggagataccgatgactgttagaggcagcatttaaagccatgtgcatgcgtcaacttgtctatttataaagtacaaggacctggtgatacatagagcgctctcctgagcctatacattccccctcctaagaccacaattccaggtaccacttagttccttccttcccaagtcacggctcacaggggcctccatatcaccaccttatttcatattctccccccccaacatgttgccttctccaacaactcttaaaattcataaaaacagaagatataagataccactacccaggcactaaaatgcctaaaaaacaaaacaaaacgcaccaatgtgctatcactcacatgtggaatcttttttttttttttggctttatttagggctgcacccaggcggcatatggaggaggttcccaggttaggggtctaatcagagctgcagctgccggcctacaccacggccacagcatcatcagatctgagccgcatctgtgacctaccccacagctcacggcaacgccagatccttaacccactgagcgaggccagggatcgaacccgcatcctcatggatcctagtcggattcctttccactgcgccatgacgggaacccccgcatgtggaatctttaaaaaaaaggacacaatgaacttctttacagaacagaaactgactcacagactttgaaaaactttcagtttccaagggagacaggttgggggtggcggggtgggtgagggtttgggatagagatactataaaattgggttgtgatgattgttgtacaaatataaatgtaataaaattcattgagttaaaaaaaaatgaacaggagttcccttcatggctcagtgattaacaaacacgactaggatctatgaggatgcaggttcaatccctggccttgctcagtgtattaaggatctggcgctgtggtgtaggtcgcacacagaactcggatcctgcgtggctgtggctgtggcgcaggctggcagctgtagctctgactggacccctagcctgggaacctctacatgccgtgggtgaggcaaaaaattaaaaaaaaaaaagaattaattataaaataaataaataaatgaacaaatgtagatgttaaacacttatcatggaacactcctggaaataaaagaagattagaactaaaaaaaaaaaatggacaatacgcaaacactgtcgaggatgtggaataatcgtgttttatacattgctggggaatctaaaacggtacaccctatgacccaacaatttcaatcctaggtgataacaaaggtccacaaaagacttctacaagaaataatagcccaacttagaaataacccaaaggttcatcgagacgagaataaatatgcaaatgatggtatagccttagaatagaatactactcagcactaaaaagaaagacacagatgaatttcacaacatacacaacaacacaggtgagcttcacaaactatatatatattacatggagggaaataagccagatacacaagagaaatacagtgtgattccatttatgtgaagtccaagagcaggcaaaattaatcaatgttgaataaagtgagaaaatggttgcttggaagaggcgaaggaaaattgataggaaatgggaactttcctaggatgacgcaaagatttcatatcttatttcgggtggccacttcaaaggtgcaaacaacagctaaaacttgtggaacccaaccctcaccacctgcgtattttattgtttggaaattatacttcagttaaaacattaggaaaagaaaataattttgtgaagtatcaataaaataacgaaaatgaagagactctaaagggcaaaaacacattcagttcaaatatataaattatatttgtgctatgtatgcatctatacgaatgtccagccccccttaatgtagccccctttcagccattctccgctcacccttgcccccatcctgatggcctctgtccatagccattttctagctgtcatcagaaatgatgcagtgaaagagcaaaagccttagagccagatagagctgcatttaaattccagctgctgagcacccataatcgagttactcggcctctctgaacgttcatttcctcaactacaaaatgggttgatgagacacaatcaaccctgttgggctggactaagagagaggcagtgtgctgattagtttctgggaaacctaattcttttgacctcagcctgtgaaaccaacttggttgtgcaaggcccactgccggcctggaaaagcccagaggatgagactcacgggctacttctccctgaaggatagggaggtggtcctgggaacccagagtctttgtgggctggtgctaagagtcgagtcgctaactcagagccatcagggccaggaaaacctatgacctatgacaaaggagacaagtttcctgccaagggttggccacctcaggatcttgcccaaatcactttgcacacccctagattccatttatccaccaaaaatggccagaggagcctggatctgaagaatttgatactaaaaacagcttctggaattcccatagtggctcagcagaaacgaatccgactaggaaccatgaggttgggggttcgacccctgacctcgctcagtgggctaaggatccagtgtggctgtgagctgtggtgtaggtcgcagatgcagtttggatctggcgttgctgtggctgtggtgtaggccagaggctacagctccgattagacccctagcctgggaacctccatatgcctcgtgtgtggccctaaaaagtcaagagttaaaaaaaaaaaaagagttaaaaacagctactatgtcttgggagcattgcgatgcaagtttgttctcagccaggcacagggttaagggtctggcattgccacagctgcggcttcggtggcaactacagctcggatctgatccctggcctgctccatgtgctgcggagtggtcaaaaaaaaaaaaaaaaaaaaaaaaaaaacccaaacaaatagcctctggtgtttcccaatctatagaagagatcaaggcaggaccaaactggttctgtccgaaagaaggaacggaagagtcagagtcggagccctgccggctagctcccctcctccaccttggcgtttcctgagccaggatcctaggtctcccaggggcaaagtttgaaatctccctgaccaggtaaaccctagggcctcttttagctcagtcttatccagtcgtggtgcatctgtcaagtgtaataataaagaggatctgcacctgcccccccaccccatctggtaggggaggcaaggtgcacccagaaataactccgagcaaggtacaaagtgcttagtgtagccaaagaagcacataagtccaataaagcatccacattccccccccaccacacacacacacacacaacctcttcgcacttggcatttccttacttccagcagtctctctatttcaggtttgtggaaacgggttctccctggaaaagggtttcccagctaggaggcggcccggccccgactccccctctcccccaccacccccggtccccgcacgtccagcgctccgagacccacccatttccaagcacaagaacaaggcgacaaggcccgctcaggggccaagaggagggcaaacgacgacaagcaaagccacaaaagcaaccgtccgggtctcttgtctttcctggggggaggagcggcgcccgcagacggtctccgcgcctccctccctcccgggccagcgggaagataggggaatctcaagtcgctctgctttctctcttcgcgcactgacattttcccccactttactgtttcttggacgcctttcaagagtttgtgcaaccagtctgtttagctgcttttctgccattttcaaacgcggggtggtgtccctttcgagtgggaacgtggtggcttaaagtctggaagggaccccttcgcctcccgtcaccccgctgcagcgggcctcttcgccgccaaagtttcggcgttccaaagtttcccccggccgggtttcgggctcggtcctccgctctctgagctccccgacttctccctctctgtgcgctcaggggtttctgtgcccctcacttcactctcaggttccctcttgcggaggcatcctcttcccacctagtcccgggcgagggaggcctccgcctcccctgccccacattgggagacagacccctccctcctttcgagacttcccgggcagtcctcctcctctgcgcgccccgagcctcccctctcccgcctccatccggcggaccccgtggaagcccgcagcccctcaggcccgacaagatggggacagagacggggtcagagttgagcacagaggtaacgacgagaacaaaagcggggacacggcagggcagcaacagggcagggccggcgcggtggcctgtcctctccccgcgctgcctccacggcgcccgcagccccgggccgggcgggactcgcggcctccaggggctcgggcagcgcccagcgggacccacctgatcggcagaagctgggtgcgctcggggatggcccacacctcggctcccggccccccggcggcgtcctcggctgagggaacagtggcgcgcggcgtgctcctgagctcggcagggcgtgccggggcggggtgtgccgcctgcgctccggcccgccggccgctgtgtgctcctccggggtggcgggcaggggcgcgaggaagccggcgggcactgggcggcgggcggcgagctccccgctccacccggcccgcggctgtttgtgcagagcgggtcccgccccagacacggccgctaggaggccgagggcgcgagtgcgcgagtgccggtgcgcgtgtgtgtctggtggccgggaggcgcagggggtgtttgtttcattttcactcaggcagaaaaaagcctgaaaccagcaaaaaaagaaaagaaattccctggtgagggtggctgggcctctttgccttctccggcctgcacgtggtgggggtggagggacccggagggtggggtggggtctatcacccagtactgcagggaggggccccggag

SEQ ID NO: 12 - DNA, 1116 bp, Sus scrofa
atgaatgtcaaaggaagagtggttctgtcaatgctgcttgtctcaactgtaatggttgtgttttgggaatacatcaacagcccagaaggttctttgttctggatataccagtcaaaaaacccagaagttggcagcagtgctcagaggggctggtggtttccgagctggtttaacaatgggactcacagttaccacgaagaagaagacgctataggcaacgaaaaggaacaaagaaaagaagacaacagaggagagcttccgctagtggactggtttaatcctgagaaacgcccagaggtcgtgaccataaccagatggaaggctccagtggtatgggaaggcacttacaacagagccgtcttagataattattatgccaaacagaaaattaccgtgggcttgacggtttttgctgtcggaagatacattgagcattacttggaggagttcttaatatctgcaaatacatacttcatggttggccacaaagtcatcttttacatcatggtggatgatatctccaggatgcctttgatagagctgggtcctctgcgttcctttaaagtgtttgagatcaagtccgagaagaggtggcaagacatcagcatgatgcgcatgaagaccatcggggagcacatcctggcccacatccagcacgaggtggacttcctcttctgcatggacgtggatcaggtcttccaaaacaactttggggtggagaccctgggccagtcggtggctcagctacaggcctggtggtacaaggcacatcctgacgagttcacctacgagaggcggaaggagtccgcagcctacattccgtttggccagggggatttttattaccacgcagccatttttgggggaacacccactcaggttctaaacatcactcaggagtgcttcaagggaatcctccaggacaaggaaaatgacatagaagccgagtggcatgatgaaagccatctaaacaagtatttccttctcaacaaacccactaaaatcttatccccagaatactgctgggattatcatataggcatgtctgtggatattaggattgtcaagatagcttggcagaaaaaagagtataatttggttagaaataacatctga

SEQ ID NO: 13 - protein, 371 aa, Sus scrofa
MNVKGRVVLSMLLVSTVMVVFWEYINSPEGSLFWIYQSKNPEVGSSAQRGWWFPSWFNNGTHSYHEEEDAIGNEKEQRKEDNRGELPLVDWFNPEKRPEVVTITRWKAPVVWEGTYNRAVLDNYYAKQKITVGLTVFAVGRYIEHYLEEFLISANTYFMVGHKVIFYIMVDDISRMPLIELGPLRSFKVFEIKSEKRWQDISMMRMKTIGEHILAHIQHEVDFLFCMDVDQVFQNNFGVETLGQSVAQLQAWWYKAHPDEFTYERRKESAAYIPFGQGDFYYHAAIFGGTPTQVLNITQECFKGILQDKENDIEAEWHDESHLNKYFLLNKPTKILSPEYCWDYHIGMSVDIRIVKIAWQKKEYNLVRNNI

SEQ ID NO: 14 - DNA, 38453 bp, Sus scrofa
ctacccagagcacatcaggaaggacttccagtcaggtggtgtgagggggagttttatttgaaaatgattccaaaacctgtaagagataaagtagaaaaacatgttttggaaacttccatgcctgctgtatttgccaaaatctgttcagtacctggtactcagctttccctgaaagatagcgtttctgtactgtttcagatgttcatttaacttagcatttttgatacagaatgcagtccttaaacatgacaattgtgtcttccttctatttttctgtgacatgccttgctttaaggaattcttgtatgtaaaaatatagaatctgtacacaaaaacattaggacctagtattggtgagagggcaagtaaatgggttatatgttatttctgagaaggcgagttggcttcctgaagatcagtctggcagagtatagattattctaagaaatcattatgaatttatcctaagaaatttatcctaagaaatcattatgaaagtgtgcaagacacacctacatatttctttgccaaaacatcatttcaaataatgaaaagttagaaacttacagggtagatcaaagactgttcagtaatcatgcaggtgtacagacgtatgtatagtattatcccattttcattttttgaaaaagtgcttgtggtatatgtgcttgtaaacagaaaaagaaagatgaactagacaccaaagtacaaattgctctctggatggtgggatcatttgtggtttaactgttttttgaatttaaaagtttttttttttccaaattttctgcggtagatctgtgttatttttatgatcagaaaaatatttagtaaactaaatctcattttaaaagcaacaaagatatattgggctatgactgcttcccaagattcatcacaggatcctttcacatttatgaactttgctatcaaaacagtatatagaaaaatagtcttcagaatcaatagcccagaagtttccaagatgtaattttttttaaaagaaaagttatctttgaatctttctcactcaaatttgctccatttccttttttccagaacagaagtcagctacgaactctgttgaaaatgaacaaaatgttttcattttgctttacaaatgaaatggtttccaaatggaatgttttacagacattaaaatagttgaggttggagttcccatcatgactcagtggttaatgaacatgactaggatccatgaggatgtgtgttcgatccctggcctcgttcagtggttaaggatccggtgttgccatgagctgtgcttgtaggtcacagacacggcttggatctgacgttgctatggctatgacgtaggctggtggctacagctctgattagactcctagcttgggaacgtccatatgctgcaggtgtggccctagaaagacaaaaagacaaaaaaaaaaacccaaaaactgaggttgacctgtgtgtcccaacactagaaataccaaagatattaatgaataaaaaatgcaaattacagatgtaccaggattacattaaaaaaaaaaacaaaacaaaacccaggaatgataacctcccctcctcaactataagggatgttttattgagaaaaaatacatttcttgaaatgctgatatgctcaaaaataggcctggggtgatacaactatgctgttaccaagtgttaccctggagagtgggtggagaaaggcaggaaacagggttttgtgggaggtgtggggttatttcctttttattttatataattctacattctttaaatatttttaaagcaatttcaagatattcaaaaagaaatctataaagaagaaatgtcaagacaggcctgtgcgtgcaagctcatggcagaagcggggtaggaggcttgcctgcttcagactaaattcctgaccttttcagagggtcagtggtcatgaaagaatgcattctcccctcttgctgattattttgcaaatacaaaaatggcaaatggggctttccagcatttcagcacaaatattccaactaaagccctaaggacctatacggttttgctatgagaaacttacgtggtttttgaagctcaaccagggagaaacttggaggatcatccccttaaccaactagttcaccaaattcatgctcagagttgggcaacatgggagatgaatgtcttccaggatcacaactttgccatatcaccccatcctcattcttgtcatagtgattcttagtaattttgcagtgtcttcagataaattctgaggagtggagctgctggatccaaacacaccctctccctttcataatgtccttcccttccctgtactctaaactacttgtatacaggattgaagcacatgggcatgaatgtccaaatggtgactctttgaaagttatcttcctaaccagatttgcctttcaaggttaacaaagaaaaaagctctaacggtggaatctccatggccatcaacactgcagggcacagtcagtcactgactctgcttatatagccctggcctcctctgcagcagcctagggcacacacgacaggcattttcggacttacagatgatggtatatatcaggatcccgctgaagccgggtttggaatcctatgtacaagtcatcccagagcagaccattctttaccacgtgtctgatgacatcaacccggctccgaatctgaaacagaggaggaatcacgagttaggcgcaacccagccagtagagagtgtcagtatggacccctcgtgtcccggagagaagcagctgcctgtaagggcagggatggaggaatcaaggagaaaagcctactgaagcagatctcacaggccgagggggagaggggcccctgagtgcagcagaaatcgagggatggaaacaggaagtggatcaggagctgggggtgcagagtggcagagagtacagacagagttggatggctgggtatgaacccccaatatagctgtgtgaccttggcaaccattctgtgcctcaagttcctcatctatacagtggaggtaatagaacattcctcctggggctgttgtgaggattacctgagccagtgtacttaaaatactgaaaacaaggcctgccacagagcaagattaccttaattcggtggtcaaggcccttaccttcaaagaatcccaactcctgacacaggatctgttgaatagtcagaggtgcacagggttaggagacaagcagagatggttttgagtttcagcccagcacttactaatcatgtgaccttaaccttgctaagcctcggtctcctctgtgactgttgtgagaaaaaaaaaaagagataattcataaaaaaaaaaaaaaaaaagagcatgaagtagcatgaagggaagtcactctaagattggactggcttcaacattttatcggtacccatgttcatgtttaccaggagcttttcagtatctggcatcatattttttttttcctgagaagtattgtgctaatgccagtagaggaaactttatcataaatgacaggctattaaatgacatagaatgatcaggagtttggcattagggatttacttctttttcgttcaccattcctataaaacaattacatccactgtgatctgagatcgcaacacaggtcaaaggcactctcattttgccagtagagatttagaaacactgcacagtttgtcaggtcgaggactgcccagctcaggggcagtatcaagatctatttcctcacagtggagggaagatggcctttcttgacctttcaatatagaggagagcacgtggaagaactaggggatgttttgagcaacatttagggtgtaaactgggaagggcttggagactcattaggtttagggatggagaaggaaagattgaagattaagcccttgtttctagcttggctcactgctgggggtaggggaaaggcatggatgttgccaataatcaagatggaaaaggagaaagaacagttgtaagaggattttgaacacgctgaaagtgagataccaaaggacttagacatccagggaatgatatctctggggggattagctctacatctaaagctggacagtgttggagagaggtgggcaaaggccgggcaggacctatggatttttggagtctttagcagagaagtggtgccagcagatgtgttcacccagccacagatttaagaagaagagtgggttgagcacggaaccccgggaaaagaagagatttaggtggtggctggagaaagagatatcttggaaggatgcagaggaagaagagtcaggaagtaaaggagatgaggacttgtctctgggctgagaaaggacttctagttcaaaatgatggaccgctctcgtgcataacccatgcacatcttccagactcaactgaagtgttgacaaaacaactgtactgggctgaactgcctcagagaagaagaaatgaagtgagtcactgacggcagtagatttggactaactaatgtgaatctggaaagctggcaggtaagaggtgtctgaggaacagggcagaggctgcagaatcccagagagtctgtggggggacattcagatgcaggaggaggagaggtaggtatcctggacgacagcagggacacacagcacaaaacgatgccatgaaaccgtggaccccttccctatgcctcagcacggctctgggccaaatgcattcagacagtgcactgaagaaatgggatcaattttgtaggaaaagtgtttgaatgagaccagggagtgtacttgtgatgccccagagcaaggacctccccgtctcagtatttaggggtccctcagcccaatagctgaacgctcaactacacagcttaaactgatgaccccttgtccaaatacaacctagatcttagttcattgcctatagtccctttaaaaaaaaatgaattagctttccacatctataaatctgggtattacatatgaaaaatccagatttctgagttttctagaaaattcagaagtacagctggagctcagtaagggccactcccttcccatctggcatttcctggccacatgacacggtccccacccagctccacccaattatgagatctttctgtggtccgtttatgagcacttgaggatatgacccctgccttcaagtaaagcctgctggataaccactccaaacatatacagaaagccctacctcagcttgaaaaggtctttgttgttgttgttgtagatatagattaatcccttaattcttaaaagtcacctacagtggaagaaagatcagcctgggataagcaacactgcatgcaactagaagccaaaggagcaacgccttcgggtgtccatggaaagtaacagccacccagcatcatgggctcagccaagctatcgtgcaagaccaggcaggaaagtacctccagtttagctcacgtgcaaattttcttcctcagattcttaagcagaaggttccacaaaggaggaaagcgaagaaagtgaagccatggtggggtctggaagtgggtcaaggatgtctctgggtggcagattggcggcagacccagagaggagcccacccaaattggagcaggaggatggagaactccaggagccatgcgtctaaggaagatggagacttgtgtactagaaaatatatttatgagtttgaaaggcaattcacgtccctcctcaaaaagggaatatgagaaggctccaggtagcaagaaaagagctcttccaagtaccggcataacctctttaaacaaacctcaacaactagaaatctcacaaaattcctgggcaataaaagcactgagagtcaaagtaaggaccaccatgtacgtgacaggcatgatgctttgccccagggtgtatcaagtctgcaagagagctgtggcttactttatcctacagatgtattatcaaaagctatggaaaagtgacttactttcaatgaaacattttataggaactcgtggttttaaaaattccaaagattatggttaacagataatttagaagttttataaatttaaatttgaaagtaaaacagtggctaaatacacagactctggagatagactgcgtgtggtcaaacccctgcaccatgatttacttgctataagacctcgggaaagttatttaatctcttggttaaatatggcattttccttatctgtaaatgggaagtacagtaatatctgttcataaggtggctgctgtattaaatgacttaatatttatgaagctgagcttggcaagagcaagttatcatgtatttggtgaacaaaccaagacatttatgattcttttttttttttctttttatttttaacagccgaatctgtggcatattctgggctgtggaagtttctgggctaggagatgaatcggagctgcagtttgtggcaacaccagatccttaacccatcgagtgaggccagggatcaaactcacattctcatagagacaatgtcaggtccttaaccagttgaggcacaacaggaactccttatcagatgcattttgctctaaatgagtgtttcacacagggtgttcctgtgtgtgaaaacccagggattttttttaactcagaaagctggcagtggattattggtttcactgaacttttggcataggcttttcttcaacagcaagtgctaacataccaatgattaaaatgtagtttaggaacacatctattataggaagctacatttacacctctacaattaagtcgccacacattcatgtgacacatgtaatatgcttaaaggtggactatatatcctcctaatttatttagtgattcatttatatagaattaaaaattacaatgtatgctcacatatatcatgtcatttgactgtcataaaaaaaactgataaggtggcaagaagctcaatagaatggaaaaaaacaacctttggacagggattcaaagcctcattattggttatctgaatcagtcggggtgaggcacccttcttggtcttgaccttgtgtccaaagccctagttcttaacatcatgcctctctgccgtaggtgagggatttgctcaaaattggagctcaacaaaatatgtgttggtttatgttgacttaactccctttccagagccacactgggtttgtttggggaaggagacaccactggagagaaggcaaggagggcagagatcagtgcttgcaggtctgagaacagcataagcaggccagctgtttggaaggaagcaggtcaagaagccagtctttgcaaatgactcaaaaagaagcaagtacggagttaatagtaatgtttcagtatcagagtattggttgtaacaaatgtaccccagtaaagtaagatattaacaataatttggagttcccattgtggcaaagcggaaacgaatccaactaggaaccacgaggatgcaggttcaatccctggccttgctcagtgggttaagaatccagctgtgagctttggtgtaggtcacagacgtggcccagatcctgcattgctgtggctatggcacagactggcagctgtagctccagttcaacccctagactgggaacctccatatgccacaggtgtggtcataaaaagcaaaaaaaaatttatatatatatataaacactactgtctgtaatatccttgcaacttttctgtaactctaaagttgttccaaaataaaaaagtttatttaggaaggaaggaagaaaggggcacttccactggtattcctgcttacttcctcatatggatgttcccggcttggtctttcttttggaaaggataaatccagaaagtcaaccaaatagtcatatcctccaggcaaagggctgaagtcctcatctgtctcaatcatctgttcaaatgacaacatggtaaagggaagaagcatatcaatctggcggtcaaggtccttagaaaattctagaatgtgcaagacccaagtgcccttaaatgatagcaatgaagcagaattaatacaaaaactgtctctcctctttgctctctcccactgccccatccctctacccatccctctccctccctccctctcttctttcttgaactgaattcaaatcctagccttctacactagcaaaaccacttcataacactaacttaaataaaatttatagagaaaattatcattatcttagtaatgagatatcaaattggctaaaaaataataaaatgtggactgtttctcatcatcacatagtagctaaatataaaagagtatcattaggagttcccgtcgtggcgcagtggttaacgaatccgactaggaaccatgaggttgcgggttcggtccctgcccttgctcagtgggttaacgatccggcattgccgtgagctgtggtgtaggctgcagatgcggcttggatcccgtgttgctgtggctctggcgtgggccggtggctaaagctccgattcgacccctggcctgggaacctccatatgctgcagaagcggcccaaagaaatagcaaaaagaccaaaaaacaaaaaaaattcttccacctactatccttttattttatgaaaggaaagatgttttcacacctcaaaaatagaaaggacctaatcttggaataatgacaattcgtccaaaggaaagagagttgacatcttggtgaccatactcagatgtgtgctcatacttatttcgttactgaccagcaaaaactttgtcacagactgtcactgacccccaggttgaattttaggattcattgattttgaggatggcaagtgttgcctggtacccagtactaatgttcaggggttgaaatttaaacttggaaatagtctttaccctggaggtaactgatctttgttcctaagggtatgaatactgtgcatttcccgatgctttccctaaactttgctctccaggcacacattcaggcactaaatataagtaggataaaatataagtatggcagggattcccagaccattttaggcctcctctttctcttgcatcccgctgcctgttgctacttattttgcttttgtggacatcctcagtttcagtgaccagcttataagctgaaccacttagctggtgagctctgtgtgtctatgtcagggctaacttaagttctagatctaggcttacttcccagttggtgcaattcagtccttacccagctgcagtccttaccttacctgcttccaggctgctacaggacaccagctctgcagtggagccacctgtctgtcccacaatttatttattttttatttttttatttttttgcctcttaaggccacacctgcagcatatggatgttcccaggctaggggttgaatcggagcttcagctgccagcctacgccacagccacagcaatgcaggatctgggctgcatctgcgacctacatcacagctgacagcaacgctggattcttaacccactgagcaaggccagggatcgaacctacatcctcatggatcctagctgggtttgttaactgctgagccatgaagggaactccccgtttcacagtttattttacttatttatttatttatttatttattttgtctttttgctatttctttgggccgctcctgcggcatatggaggttcccaggctaggggtctaatcggagctgtagccgctggcctacgctagagccacagcaacgcgggatccgagccgcgtctgcaacctacaccacagctcacggcaacgccggatcgttaacccactgagcaagggcagggaccgaacccgcaacctcatggttcctagtcggattcgttaaccactgcgccacgacgggaactcccccgtttcacagtttaaatagctgtcactgccataaccaacacaacacaatacaacacccacaaaaacccaaaacaaacaagaaccaagacacggtgatggaggaaaaagaatcctccaaaagaaaaacagagctggatctacatttcattccctacattttcaacattccctacattttcaacaaaggattgtttcagcacatagtccaatacgccctccgtctgacagtcagtaaggctcaatgaatgcttattgagaaaccaactggaatactaagaggttttcatatagctctgtaatataagaaaacaaaaacaaataataacttcatagcataccctgaccaccaggttataatccttaaatccagcccaagtgaagtattcttttatccaggatgagtgacgaaatatttcatctcctatagcagcattcaagatattcaaatatgggccaaaatcccaggaatccttgtaaatcttagtcccttctggaggctctacgatgcccttgcttaaagacacaaaggggagagaacaatgaaaaaagaaagcaacaaataaggaaggcagaagtttgcacttctacatcaacagtcaactggatgagcagctctaaggctgctcagatagatgatgcccaggggtcccacagatgtgcctcagggaacattgaggagtagggccccaccccagcctaaaccaggtcagctcctgttaattgcttagtgtgatagctctccaagtcagaatacatttaaagacgaagtctggagttcccgttgtggctcagagggtgaagaacatgacatagtgttcataaggagacgggttccatccctggcctcattcagtgggttcagaatctggtgttacctcagctgcggtgtatgtcacagatgcagctcagatcccaccttgctgtggctgtggtgtagaccaggcagctgcaactcccattcaacccctggcctgggaacttccatatgccgcaggtctggccgcaaaaaagaaaaaaaaaaaaaagataaagatccatgtccggggaaaaaaaaagttggaataccacggatgtggaccctttgggctcaaataactaaattatgaaaatgttgaatataagtggtcttactgattttgtggacatccgcttattcctgccctgcccccacctccattagactacaagtatgatgaaagcagcaaccatgacagtacacagaaggggtcccataaatatttgttgtacataggaataactctagcctatctttgagctacacctagaattttgtgtctctcatatacagccctcttattatactaataataccacagctgatagacagatgggctgacaggagacccagtcagcagtatggacaagagtgtgctctgacatccctagagctgtccatccagtgtgaagatggatcactgcatgcaaggtggaatcttgagtcctggcaatagaataggacgtgatctggagaaaggaaatatgaggagggaaataggcatctgtgtagtaaagatttggcaggtaatggtaggtccctacattccacttctccaaacactgttggcccaaagccggagatgcactggttttggtgataaattatgtgtcagatcctaaaatgtctaacttctaaatgaatctcatatctgcttctctaaatccttgctccatctcagccagcagcctcacttatctcctcctggaaaaaagcacagtctcccagctggcccccctgactctaggagttcttccccaggacatggtttttctaaaacacaatgcagtaatattccttctttgctttatcgctttctcaagctctccttactcacaggcaagttccttgccctccaggcaaggtcttataaggactttctgaccctggtccaacacggcatccctgtctcatccttttcctttaccttcatttactgaaggggatgaatgacttcataagggaaggacctcttcacagctgtttcccctgtacttagcatgatgcccaaaggagctcaataaatcatttctggaagaatggcatacatctatgcacttattcaaagtaattgtactcactaagagcattgtaaatcaactatatttcaataaaaatattaaaaactcaaagtatctgcactcaccaaacctatgacattattttcaccccctttctccagcatatccctctgactggaacctcaatctcttaatcactctattggtaaccttctcctgacctctaagacatagctcaaatgcctaagattggaggttgagcattccctgtccacatctcctgttctctctagccctctccctacctcacaaggcagagctgagcactcagtctcccggaatctcttatactttgtcttactactgagaacctaacatcaactctcattacccagaatgctttggtgtgacacaatgatgcatatgcagattccagggctctgcttcagatctactgaatcagaatctcagggggtggagcccagggagctgcatttacccagtttccttgggttactctgacgctcactctagtttgcgaatttctaccataggatgcgtctggggaactagagagggataatggagagagttcagcaaatgccaggtgccagactcttgaattccccactaaaacgtgaaataattaaaatcttctctcaccttgaactagagaatgaaaactgcctttatcctagaggcactggagagatcctatggaattttaaacagggaagggaacgggaagagttttgcacttaaaaatcatttctttggcagcagtgcagagttggagctttcaaacttcttgcctaagatcccaggaagaatatattttacatcaggactctaggggtccatatgccaagagtatctgtgaaaccagagtttcctgaaataatacttacccttgttatatgtgctcaggcaacatactcagggttgttctatacaattttgttctacttctttttattttattttatttttgtcttttttttttttttttttttttttttttttttttagggctgcacttgcagcatatggaggctcccaggataggggtctaattggagctgatgctgcaggcctacgccagagccacagcaatgccggatcagagccacgtctgtgacttacaaaacagcccacagcaatgccggatccttaacccactgaacaaggccagggattgaacccgcaaccttatggttcctagtcggatttatttctgctgtgccacgacgggaacgcctatttcctttttctaaatgctagttgtgatgccattgatttcctaacccatcaatgaatcgtgaccagcagattgaaaaaggctggcatggaggatggatcagaggacagcggggctgggagcacagaggcaagtcaggggccactgccagaattctggttaaaaaaaaattgtgagaggctgaatcaaggccacagcagaagaggctggaggtgagtgatggatttttaagagatttgtgaaggagaattgaccagatttgagctgtgggaagttagtaaaagggtataatcagctgactgtgtcccagaccccagctttgcaaaggtaaggccaggagaagggtgtgcttttggtaaccgtgtgccctgatctccaacagagtcacagtccacttctaaataatggtgaggaatgatggttccatccggctcaagacaagtacttataaaaatacaggtctggaacatccacattaatgtttctgaactgtactcccagggcaccgttaattgttcaaatggactgtctggggattggcgaggaggtaatatttacactgataggaacactaactctcaggcttattgctttctacttgctgaagacaacttatttttgagctgtaataatggcccttcataaaaaaaactttctcactctttatcctgaagtaaggttctgagacaaggaaaacatttgagtaattatcttatttatttatttttttttcaaggccacacccacagcatatggaagttcccaggctaagggtctaatcagagctggagctgctggcctatgccacagccacagtaacgtgggatctgagccgtgtctgccacctacaccacagctcacggcaatgccagatccttaacccactgaggggggccaggaatcgaacccgcatcctcatcgatactagtcgggtttgttattgctgagccactacgggaactcctaattattttataggataagaaaattattatataggactgtgaaaaaactcagtctcccccccaccccagagttgaaagatacttatttaatagtttattttatacagtaagactcccactttaaagggtggtgtgtagatcttaatgcatgacaagctcaggatgctagtcaagaaaaacttaatattcctacaaacagggacctgccaagaggccataggtatgccctttattttctcataaacatgaaaaaattcagaaatcatttttgttccctgtaaatattcaagtcaaacctgtctgttgggtcctttagcatcctacccagatcaagagtggctccaggtcttggggtccaggttaccacctcagaattcttcttgataagattgttgagttcatttgggtcatttttgatgtttgtttccttaatatacctgacaaataagagcattcccatgtaaggcagtttattttcagatgacattcttatttgaacaatgacagaattattttttatttctttgcattcctacttcccaatccttcttttcttaccccaggaaaaataaagactatacttgagctaatgtccctgactagggaagagctgttagtcaaagaaggttgactctatacttcgttttttagtataagcatatagtgtttggaattgaagttagatgtacaagactattatacataattggtaatagcacactcttgtatttaattttttttattcatactctctgttttcaggctgcttgttaaaataagctccagacccctactaatcattctttctcatttcatgttgtttcacagctaaatcactcattcagcatatattaacttatgcgtaaacacgttatataaaatatccagccatacttgtctgctgggtgggattccacgaaatacccagcaaaggggcagtaaattctgggttgtaggtccttcaccagccgagccttgtagttcaggagtttcttcctttctgttttaatgaattgggctttccattcctctggaatgacagggtttggattagtcttctctgttcagaaatcacagaaaaacaaaagttctagtagattagaagtcttgcaagagataaaaattgacagttgagtgatgcagaagtagaacaaagctccttgtcattagtggctttattttgcaaagttggttactaggaaaatatcccaaactagtcaaagacattgaatcccctctttgtttacggcaattcatttggatccaactgaaaacacagggcagcatgcatagttgtaccctgggtgcatgcatattttaagggcactgtcgattaactctctactaacatgggcatggctttgttattttggtggaatataaaagtaaagtatgttcattacactctggagatgcacagtggtcaagagcatggatgttggagtcagtcaagatcaaaatgcagctccaccacttcaattctttaagtctgtttttctcctctgttgaatggaatcatgatgcctacctcacgtgttgttcatttgttcgtttgctcattctttcatttgatcgatatttattgagcacctactatgtgccagacgtagttctaggcactgagaatacagtggcgagcaagataaagcaggtccctgctctcatggagcattcattctagtgaaagaagcaaataatgaataagtaaataagttcatttcaaagagtgatgagctaggaagaaaataaaacagagccaccaaatagagagtggctggggtaaggatgaggacgggtgggatggaagggcatattagaagggtagttagtgaagatgacatctggaatcatagaccatagacacagacacagaagagaagttgctgaccacgtggtggtcaggggcaatagcactctaagcagtagaaatagcacatacaaagacccagggcatggagctacatggtgtactgagtctgaggaacgaaaaacaagccagtatggacttatgcttgtcaagcaatgggggtatgggcaataaaggaaattgagaaattaggcagggcccagagcatgtatggtaccatgtcaggtactccttctaccattactgttatgaaaatttgataaacacaaacaaggatacaggggaaaaaatgttacctataagctaggtgtaaccactatgaacatgttagtatattacagaccttttaaaatgtatgtgcatgtgcacatactcacacacatacacatactcacataagaactgaattatgctaccaccctttagtaggtatgttttgcctccctagtcacactgttaaccccataaggacagcaccttccctcatctctcacatggtgatgcattctgggaggcaatgaaatcagacttacagaaaaaaggaaggaactggacaggttttcttcttattgcaagtagggcatttttgacacattactaaacagagattacttactaaaaacattaatttattaagcagacatatattgaacacttacaatgatagtactgagcaaaggtatgaaaaaaatataccacttaaccatcctccccatcccagccccagaaccacccttagacacagagcagaagagcttctgccttggtccccacattttttctagctttgagatataactgacatctagtattacataactttaaggtgtacaacatggtgatttcatgacatgcatgtatggctaaatgatgaccacaataaagttagttaacaccgccatcacctcacataattaccatttctgtttgtgtgcacgtgtgtgtgtgtggtgtgtgtgtgtggtgtgtgtgtgtgtgtgtgtgtgtgtgtgtgtgtggttagaacatgtaagatctactctcagcaacttccaagtatatagtacaatatgctatctatagttgccatgctgtttattatacccctagaatttattcatcttgtaactggaagtttatactctttgaccactattttccctaccacccccccaacctctcgtaatcccacactttagaggggcttccttagcctcatccctcccccgtatgagctttccacgaggtcaagggtatgtatccccctcaggctgcccacactctgttctgaaccacatacaaagagcacttaagcctggattaccaatgtcagactctttctgatcagctctatgttctatgtcaggaatccatttgatccaaattattcttgatttttcctgagattctccctagtctccttagtgtttcatgctccatcagcatattctcagctggaaactttagtctatatttgtgacttgcaagtatgatttcccaataagattgcacacctcttgtgaggaagaaccatgtcctaattatctttgtattgattcacacagcatttagcaaagtgccatgccaactccttggcatcattttgatataaagaattaccagtaaattttccaccactgaaagtcattggaaagcctgaagctcctccagcaaaatcactcatcattaatgcaaccttcataggcagccttcctccattgggtctggtgcaatccactgtattgagtattttatgacctgtgggaaaacaaaatggcatcggactcaaggtgaaatcttgaacaccatagtttgaattctcaggccaacagtcttccatgtaagtctatataatctgcctcattcaattatcgaagaattgctcacatccaaggaaaagagagagtaagatttgaaaatttatactcttgagtgacacattttgaactttcaaggaaataaattcattctgtctgattcagtgggttctgaatgaggacacttagcctgattccactccaggatcataaacagactactttccttagcaaactatattcaaaggttaagctcaaaggatgcagaggaaagtaatcagatcaacacaactctctcaaccttttggaaattcttttcgatgattattggggtaaagtgtatgattccataacataataatattcaagatgaaagtaaaacatttattcaataatgtcagttttaaggaaattacaataggtgaaatataggatatttttatctgttgccttcaaaaaaaacctttgcacctgtcacggcatagagtacattactaattgattctctgtaagattatatgaatgacagtccattttcctaagacagagatagaatatactgtactctatggaaaatgaagagggaagaaacagatgaacataggatgatgttttggataactattattatcctttctaccaagagcaattttcattgctgatgagggtaagaaaatacctttgtattccacaataatgcaagtgtccatctcaggatgaacgccatccatcaagatcatgaatcgaagatttttgtctacctggaattcaacaataaaaccaacaacggtttacatctattttgcttttaattcaatatttgaagaaactgtcctctcttctggaaagaaatccccttttttcagaactggatttgttatccatcagagtcataccatggataattggagaggaagaccatcttatttcagctcaaatagagatttacacaggaccatgtacagaaaaagtaggccattgtttctttagtcttaaaatttctatctcgcctcaaatttatcccagaaaggataacccaaacatgtggaaagaacacagacctgctgccatattccaaatggcactacattgatattagtcaactggacgccactctgattcagattccaaaatacaggtctttccgtgttgccaacataaatgggaacatctggtcttctctcagcaagcttcttcagtgttgggtaactagggtcagaaagatatacaggttgaaaggtgaaaaaatagaataatctagtataagagagagtgtgatccttacaccaacacgttgaccgagaagcaaggaactgaaaaactagactctccccagagtccaaaagaagagctctttcctcaaggctgactataacagtgaggaggatttcctgggagagtcctctttattgttagaacatcccatataccacggcatgtatatcaaaccaggtgtgcaaattccgtcttccacactgatgctgctttgtgcaagggtagttctaacagaaagtacagagtggagaagttacgccaaagaggtttctggtttcatcttgattttccttttttttctcattcctcagtgcagctccctcccagtgagagaaaggtctcggccatatatctaagagaacggatgggtgcccaccctggggcagtttttcaaacttcgaaggttgatagccacacatggtatacagaatgaactccttgtccttaaagagagttagtcactaactaagcaagacaataaagtttagcacagaggaaaatgacatttacctcttgtagcaatcccaagtcagtacacaatgaaccatccaagcatttttgagtacttacataagttgccaactttcatttattagaatttattacataaaaggattatatactactgtgtgggtggcaaaacatgaacaataaacaaataaatggctctgtaggtatatttcaatcatagtgttacacactttcacatgttattgtatttgattctcaacaaaagaccctttcatcttttagtgtgcttttaataaatgaggaaacacactcagaaatatatgactaacaaatagtaaattggtattcaaattcaggctttctgatcctaaacttggtgcttcttctattgaaaggaaattctggagttcctgttctggctcagtgggttaaggacccgacgttgtctctataaggatgcaagttccatccctggcttcactcagtggatctggcgttgccctgagctgcagcataggttgcagatgcagctcggatctgctgttactacggctgtaatgtagggtggcagctgcagcttagattcaacccctagcctgggaactttcatatgttgcaggtgcaactgtaaaaaaaaaaaaaaaaaaaaaaaaaaaggcaattccaactctaatgaatgtgctatcaggtttaagaatcatatttgtacatagactataatgtctggtgatataggatatttactcataagaaaaatataaacaaaatcagcatatcagcacttattaaccatactaatattcaagttccaaaactatatttaatatgtagaatccagagggggaaaatcattaggttttcttctctaaaaacaagggattcaaaaaaaaatcaaggattctttgaacatgtctttaatctctgggttaacatctaaatcttccactttaaagggctttgggagttaggataaatgattctaacatggatgtattttaatttgtgatttttaaattattgacaattcttgctggtgtctattaataacactattataatactcatatatttacataataaaatcacatttctttgactaaagacagttttctaaagcatgctggccccctccccctttgtttttgtgaaccaataaggcattattcagtaaataaaggtcagacaagagcaatggagataaatgactctggtgtttattagttgagcaggtaagagtcaaaaaactcagggtcaattctgtcaaggaaataaactcaaaggagtgaaaactgcaaggcttggtaacttttcagccataagctatctgcaatacactacccaactaaagcattgtgatactacagttgagaagtggctttttaatgcctggcaactttgcccacacaagcccctgaaatcaaaatgaaattggttttcaggacagtggttgggaaatgaccagactgaatgccataaaaagttcttatcctcactaaaatgtagtatactcccatagaatatctcttgctaggacaatggcaatagcatcttgtgacaggcactataaagcaatcgcctccttatcttgacactgttctctctaagcaagctgtacaaattgactaccacacaacatagttattacacaatgcatgaactcagggctctcataatcctgaaattacaagtttggttccagaacctcctgtgggacaaagatatcatgtagtagacaagtagatttttaatcgtagcacaatactccagtgggtggtattcggtttttaagtgtgttacaggtaatttgttactaaagctgttaattacttaagtttttaaaccctttccttaaaaagcgagagaacacacctgtgccttcgagatctcatggactttcaatagaaaaatccaggggccagtcaaccaacaaacaatgtattttccctaaccatggacattactatcaaagtatatccttcatgtgaacttgtcatgtaaagtcacaggaaaaaaaaataaagttgaaattgcttcattttagaacaccatgggcactgctgggtattggcaacctggcagtagcaatacaaatttctcaataaggatgaacacataggaccctgtaatgaagccagggggttgggaataggagcattcacaaatatttgtaacagtccattcacaaatatttgtggtttttgtcaatgaaagttcctctttctccctcctatttgatcgcctggattcaggaagtttccgtttctatccttagtatcatatggctctggtttcactgaaggatgtggtggactcagggttcaaaagttgagagctcagtgttgtcgaaatgctacagatcaggagttggcaaaacacagcgacctgctgctgaatgctaggaagggcttttacctttttttaaagggttgaaagggaaatcaaaaggcaatcatgtttggtgacacaggaaactgtttgtgatattcacacgtcattgcctataaagctgaaggcaatcaggctccttaggaccgactatggctgcttttgtgctataatagtagagttaagtagttgcaatgccaaccatatgtcttgtaaaactccaaacagtttacactctggtcctttgtagaaaatgtgtgctgattcccaccataaatgttaaactaaaaaaggaagtcaactttgatgatccttaaactcagagttttaccaactagcctgagggtaggacgtgagagggtccagggttattaaccccatgctcctttccacaatagctcttctcacatcccaatggtataaaacaggaaggcactttaaaaaggaggctatgcatgttgctatggcagtggcgtaggcccggggctacagctctgattcgacccctagcctgggaacctccatatgccacaggttcagccctgaaaagacaaaaaaaaaaaaaaaaaaaaagtttttaaaaaaagaggctatgcaaatgcaagcatttatctgaattagttctctttttatcagcccaagcgaatctacctcagaatgagcagtgattacaaaaaaagctgaaaaccaacagtgcttttattgcagcattttcttcggagttgagggctcacccttccttacctcaggtggtctgagtgcatgtgactgatgtaaattaaatctgcgcggctcagcctctccagccaatcagatggaggctcgtgtagtaaccaccatcctcgcgcaaaagcaggaccgattaaccaaggatcgaacaccatcctcttgtctcccagcttgaggtccatgcaggcgtgagtaaggtacgtgatctgttggaagacagtgagattcagatgatcggatcattaccagccagaaaaaggaactgggctggttagcagacaagccacatgggggacctttgctcctaagcatgttcaatgacacaggactcaagaaagacacagcaggagcatttccgtagaacacaattcccagcacaggcattactttattagaacagaaatgctcatggtgggttttaggggtcaaaccagttgatttacccaactcaaatcacctccaaggtatttaattatgctctgtaccacagaatatcttttgttaccagtcttttagaacacaatttacaaggaaagggagttacagatgttatggcagacctctggggatttaaatggtagggtggctgtgaataggtataagaatgactggttccagtgggtggacacagtcatgcagcctggctgcactggcttctaaggctttctcacctaaattacttgcggactcactcaggatgtcaaggtcctttgagaagggtgaaaaacaatgacttagagacaggcagagactacaggattctaaatcaacgccttactcccttcccatagtctggcacgtccacaggaaaaatgaaaacaccaaggagcagagataaggtcacagaaatccaaatgtgaaaagccagcaaagaaggtagggagaggtcaagaaatcaaatgcaggtgattgtgcctcttctgggtaggttcccatttgtctcctcaaaaaagtaagagcccatttttacaagcttcccgaatactccagaaaaattaatttttggttgtttacctctcccaaactaccaaagtgttttctctggaggaaattctctctctctctctttttttttttttttttagggccatacctgcggcatatggaggttcccaggctaggggtccaatctgagctgtagccgccagcctacgccacagccacagcaatgccagattcttaacccactgagtgaggccagggctcgaacccctgtccccatggatactagttgggttcgttaaccactgagcaacaacaggaaccccgaaattttcttttaaaagtggaaaaatgcacagaaaagtttgtaaagatcttagggcaatgtgcagaaacatgtagctggccattttatctgacagtgatctggtagcaagggcagtttctgaacttcctcccatagctgtgcatgactctcctttgggacctctgctaaaagattttttttttaatctagatatatttccttgtaatccttgccaagttcctgaggttcctaaataatgtgctcaagaatttagaatagggagttccctggtggtctagtggctaggacttggtgctttcaccactgcggctcaggttcagtgcctggtctgggagctgagatccacatcaagccactgctcaccatggaaaaagaaaaaaaaaaagacttcagaataactttattatatgtcctaactagccacttccaagaatactcaaggtaatataagatgtaaaaaaaaaaaaaaaaatatatatatatatatatataaattgatatgttagctttatttgtgtttttaagaatattataatttaacatttccttacctgcacttccccaaaagccaaatcttcaggagatctgggttctgaatcccacgggttaggaggatttagttctagaagcaaaactccattttcttcatccttttctacaactagaagcaaaggtggacaaatctggataatcaaccaaaaaaatgacttttaaaaagcatcgctaagacagaaatgcatggctcaagtacatggagtagacaaatcaaagcaaaatcaaaataaaaggcaacgctcatttgggtcaagcaacatctgcagagatgagggctgaagaccaatactgttcatctcgctattcacattccacgtaaggaactcatgagatcgcagatgtgtcagagacacaggcacaccaccaccaacttcattacaatcaaatgaatgattgatagagatgagttcaaggtgctgtggaagtgtctcggaaggaaaaccttgtttggttgtaagagtcaaagctgatttcaaataggaggtaatcctccagctgaacttgaaagacaaagtatttgggggctgacaaaagagatgtgatgatgggatatctcttttggataaaagataaaaggacaacataaaagataaaagaacagcatgtgcaaaggcatggaggcatgggagagctggatgttcacaaatgactggaattttatgaccaaggagaatggtgtctgaaccaggtgggagagacaggtaggtcagagtgggtcatgaaggaccctagattcccaactaaggaggcgtctggatttcatcctgtggcaatgaggggtcaatgaagaattttaagcaattgtggcaggcatgctggtggcttgcgcaaaacctattctctccttctcccttactattagcatcctaattgtgtgatggtacacctatttaaagatttcccagccccctggcagttatgagtggctatgtagacctagcactatgtgcagtttacatagttctggcgggtgagacgtaagcagacgtctacttcagaagtctcacgggacttgcaggaacacatttatttccccgacaaagagggacaactcaagagaccagcactgtctccccttcatcccttcatatttccccctcttgtgtggaatttgactgccatgcttggaggagcacaagccatcttgagatgctgaagaatagagccagacactgaggatagaacaggaggtgatagggaatttggctccttgataaacacagaacaaccataatgcccaggattacctgcttgggatctaagaaaaacaacctcctatatgattgagcaacttttgcctggtttttctattgcactggctgaaagcaatacctaagtgctatagcaagggagaattaaaatcagaacttaattttagaaagacccgctgtgaggcacatggagaggatcaattggagggaggcaagaccatgtttgagagtcctctctgttgttctggaaggctatcagcaaaccactaatggacatgtgcttgggagacagatggcctgtttctagccctcactctcccacttaatagcttattagctagaggaccttgagcaacttatttgacttctccagtgtttttatctctaaccctggctatctccacacacagttaatcctattactgccagcaattttattcattactaaatgaaagcagatgaggtcccaagccaaagcaaaccttgtggaaatggcattgccgccctgccctcaaagacgagcactttcctactttattcaaaggacattaaaaaatgttttgtgggagttcccactgtagtgcagtgggttaagaatccaactgcaatggctcgggtagctgtggaaatgcaggtttgatccctagccgggcacagtgggttaaaggatccagcattgccacagctgcagtgtagggcacagctgcaacttggagcctggattcaacccctggcccagaaactttcatatgctgtgggcatggccctttaaaaaatgttttgcttacattttccaaatgaatattaattatactcactttaagacaactgctagtggaagaaactgaagtaaaaattacccgtaaaatgaaaaatggcacaaatgaaactttccccagaaaagaaaatcatggacatggagaacagacttgtggttgccaagagggaggaggagggagtgggatggactgggagtttggggttaatagagcaaactattgcatttagggagttcccatcgtggctcagtggttaatgaatccgactaggaaccatgaggttgccggtttgatctctggcctcactcagtgggttaaggatccggtgttgccgtgagctttggtgtaggttgcagatgaggcttggatcccgagttgctgtggctgtggtgtaggctggcagctgcagcttcaatttgacccctagcctgggaacctacctatgccaagggtgaggccccagaaaagacaaaaaaaaaaaaaaaaaagacaaaaaaaccccaaaacacatatacaatagatgcaaactattgcatttggaatggaaaagcaatgagaccctgctgaatagcagagggactatatctagtcacttgtgatggatgcatattatctgcatcctgggctgcaatttcctgatctgtcaaataggattatgatacatactttgcagagttgttgtagggattaagtgatataataaatcctaaagtgtcactatgcctagcacagagaaggcacgtaataaatgatagtattattatggcaattatttcaccctcaaggaataaagaattaaaaaggaggttcaagactgaacaaacaggagttactatcatggctcagtggttaacgaaactgactggaaactcaggttcgatccctggccccgctcagtgggttaaggatccggcattgccacgaactgtcatataagttggaccccgctttgctgcagttgttgtgtaggctggcagctgtagctccaatttgacctctagcctgggaacctccatatgctgtgggtgcagccttaaaaagacaagagacaaaaaaaaaaaaaaaaaaaaaaaaacccacaaagattcaagaaacaaaattatatgctagcacataaccagttcaaaaatacaaggaattgggaattcccattgtggctcagcagaaacgaatctgactagtgtccatgaggtccatgaggagacagattcgatctctggcattgctcagtgggttaacaatctggcattaccaagagctgtggttaagtcacagatgcagcttggatcccatgttgctgtggctgtggagtaggctggcagctgtagctccagttggacccctagcctggaacttccatatgccacaggtgcagccctaaaagcaaaacaaaacaaaacaaacaaacaaaaacccaaaaaaaccgaccaacaaacaacaacaaaaatcccaaggaattacaggagactttcagaaaactacatcgatatccatgcttaaggattttccttctttagaagtgttctttttcaagaaaagcaggaaaaactgagtctgcagttcttaactattatttcaaagccaataccataaaagtttttatgccccttgctcaaagataaattgcatttatgcactgaagaaaatcatgacatctgccaactgcctgcatctttatagaatgtggtatccttactttgaccacataaactaatgacatctaagttatttggattatgacttaatatttaaccagaagaacaaacaaatggaattcattaaaatttttaatagggaggaataatgaagaggaattataataaaaacatattagaaaactataataattaaatcatagataattggcataaggacgaagagaggatcctaattaaataacagtttaatatagtctaagagaaggaccataaattagtggaagaggaagggctgcctgatacacagtgctgtgcaatggttagttaagtattccaggtgcttaaagacacaaagaaaagcaaccaagtgcttaaaaagtatgaaaaaaatggcatatcacaggggggacttctaagtttaatagcaatggaaataattccaatggaaaatcttagtagatagaaaagtaaaatgaaaaatttctaccacctaagaaaatgggcaaacacacttggaatatataagcatcgtatttgaaaaacaagtataatttaaaacaatgatgctatttttggttcaaatgaggaacgtttgaaaaactagaatgccctgagctgataaggaatgaggagaaaaggcaggctgattaagtagttaatgggaacaaaaattggttgggttctaaaaaaatggattataatgcaatacacattaaagaatgggtaaatgaatagtggactcattcattcatttaggacctcaagttaagaggattatgttaaccatatttctcagttcatgacacattatattcagtccaggcagagctacttacttactccctttatctttgttttctactcttctttactctcctcccctgtaggcaaccatttgaaagttcatgcaaaatatttactacattgtatgtgtgcatctttaatttttataaatggtattgggtttccaggctgtttcttactctttttcattcaaatctatgtttctaagatacattcatgttgccatgtggacatctcatctctaactggagtttcacataccctggtgccacattttattgattcatgctcccaggggtggacccatagattctgccacaacaggatttctttggtacataaacaggcgtgggattgatgggccacagtgtattcataaacctgctctgcctaaccactgtcagattactttcccacatgactgcaccggccatactcccaccacaggcatgacgatttttatatcctttatccctgacatttgatatcacctttgtttctaactttttatcagtcaaaaagatgtaaagtaaagcacctcattgcttcagtctgtagttttctaataattaataggtttgagcatattttcatgtgcttattgacttttggagatttttcttttgtaaaatgctagttcatatcctttcttaatttttgtattttcttaatttttatattgggtttcctatctttttcttgtcgatttgcattacttcctcctataagctggataatattccctcattggttgtaaatattgcaaaataatcactcaaactatcatatgttctttaactttgtccatggggtcttccagttcatagaaatctgtagtgtatcgatgatatcttattcactaggtttgtgtatatgtgtgtttcttttttctttcttttttccctttgggctgtacttttgaagtattgtttgaaaagtcaagaagtatcagtaatctctaggtcacaaaaatagtctacatttcttccattactttcatagtcttaccttcctcatttgagctatcagtccatgtgaagcccatctttatgttaaagtatgaggtgttaaaaaaaatgggcgggagttcccgtcgtggcacagtggttaacaaatccgactaggaaccatgaggttgcgggttcgatccctggccttgctcagtgggttaacgatccggcgttgccctgagctgtggtgtaggttgcagacacggctcggatccagcgttgctgtggctctggcgtaggccggtggctacagctccaattcgacccctagcctgggaacctccatatgctgtgagagcggcccaagaaaatggcaaaaagccaaaaaaaaaaaaaaaaaaaaaaatgggcgaaagcatgagttagtcatatccttttgccagtaattcatttgtctcacagaaacaactccaaacacaaagcagctcttacgcacaatgatcacagtttcgttttgatggaaaaaaaaaattatgaacagtctaaatttcaacaacagaaaaatggctaaataaatcatgtaagttaatatttaatgtaaacatactttataattgtgtatatatggaatctgacctaacatgactactataataattttaacaagacaaaaaacaggataaaaaaagtaatatataaaataattacaattgactggaacaactagatagaagatgaacaaggaaatagaagactcgaacagcactataaactaactagacctaacagacaaaaaaagcacattccaccagcagcagaatacacattcttctcaagtacatttggaatattctccagcataaactatgttatataaacgtttcaataaattttaaaagatcagtcatacaaagtatgttctctgaccacaatgaaatgaaattagatactaataagagaagaaagttggaaaattcacaaatatgtggaaattaaacaacatacttctaaatacaaacagtttaggaaagaaatcacaacagaaattacaaaatgctttgatacaaatacaaataaaaacataacatgctgaaacatagaatgcagctaaaacaatgcagtgcatagaaggaaatttatatctgtacacacctataataaaaagaaagatctcaaataaaaaaactaaacttccaccttaagaaattagaaaaagaagatcaaactaaacacaaagcaaacagaaggaaggaaataagaaaaaaaattagagctaaatggaatttagaccgggaaaacaagagaaaatcaatgaagataaatgtttgttttttgagggagttctcgtcatggtgcttcagaaatgaatccgactaggaacctgaggttgcaggtgtgatccctggccgagctgtggtgtaggtcacagatgcagcttggatctggcattgctatggttgtggtataggccagcagctgtagctccgattagacctctagcctgagaacttccatatgcctcaggtgcagccttaaaaagcaaaaaaaaaaaccaaaaaacaaacaaaacaaaaaagttagttatttgaaaagattaatacaattacaaacctttagctaaactgaccaagaaaaaagagaaaagacccaaattactacagccaggaattaaaagggggatattactatcaatctaaataatccaaatgaaatggagaaagtcctaggaagaaacaaatgaacaaaactgactcaagaagaactagaacgtctgaggagcagacccataacaaattaaagagatttaattagtaatcaaaaaacttttcacaaagattagccatggcccagatggcttcactggtgaatctgaccaaatgtttaaagaagaatcaataccaatatacttcacaaactcttccaataaatagaaaaggagggaacacttctcaattcattctatgagagcagtaattattactctgatccccaaaccagacaaagatatcacacaaagagaaaactacagaccaatattccttatgaatatggacatagaaatccttaattgaatattagcaaatataatttagcactataaaaaagaattatgaccatgagcaagtggggtttatgctagcttgattcaatataggaacatccatggagacagtaagtagattagtggttgccaggggctgagggaagaagggaatggactgctaatagttagaaggtttctttgggggatgatgtgaatgacctggaattatatagtgatagtaatagcacaacatgtgaaaatactaaaaaccattgagtcaaacactctaaaagggtaaattttatggtacctgaattgtattccaataaaaggagaaggaggaagaagaggaggcaggggagaggcggggaaggggaccaaggtgacaactggcagataccaaaacactgatggaaatgtaggtgagagtcttcttccttctactttcctaacatctaccttttttaatgatgaccatacaatgttatttatttaacaataaaaccaaataatctcagctcacatgggattgagccatccttttctttcttgggatgtggtatgaaatcactacagtattggtagcactgtactgaaaagtgggttctgttaacaaaattttctactctcacaacattaccttactggagcagaggctgaaaactgcagtgggtcttgttatttccagtcctccactgaccctactgacaactctggccctgcccttcacctgccgtggcagtgaacatcaacgctttgcatcatttcctggcctcagtctattttccagtttacccaactttctgctgggtgggaaatccctccttcctgctccacaggacccagtcacaaggcatatggcagactatttgagtcatacatatacaagcaaatcattactctgtactctgtcgtaacacgttctgaacatttaacagatgttctttcaacaacccagtaaaatcactactaccaatattatctcccattgaggaaactaaagaacagagactaacccacctaaagtcatttaattgcatgtttgagcatcaggatatgaacccacgctagtgagccccattcactcttaaccattttgctaaaaggtctcactataggtcttatccaaaagacttagctcccttaaggagctataagtttctgggttacatactcataaagtagatggtcaattgtcctctcacctacacaaacagtttaagacagtcaaacttttgcttcttatctctttttttttttaatcagatgaattaaatagtatttgtacagcacatgtaaccagttcctgctaacaatgtgatctgaagatttcctaggctaggtcaacagacaaagggtgggggctttctggcaaaagaaggaaatggttcaggcatccctttgaggggcaaggtgagaattagtcaatatttccaaaagtcatttaattgtgttagatcaaatctacttttttatttatataacagtcattctaaaacagtgtgtaaaagcagttttaagaatcttcccaagtaactttttatactgataaagacatttttaatcacttagaacagagacaaatttattcctatgattaagcccttcttactcatatttctataggctttcttgagtaggaagaaggaaaaagtagaagtggagccagcatgagaatcacacagaagctgtagcctctaacgtgtgccagaaagagtcatggaatttgaaggactttatttcccaactggaattgtgagtttcattataacgtctcattatatcatctcatttacgccgactctatcttatccatctttgtatttcttaatacctagtgcaatgtttacacatggtaaggtctcatcaaatacttactgaacaaatgaatgaatgaagggattttttagagaaaacttgcctagaattttcagtgatggttacttttaaaatacctcagtttaaaatcagaatgcatccaaggcttctaatgagattggaaacaagttgacaagagggaccccaatgacagtaacagcagaaaacattgatcagtattgatggtatttacccagttcgtcttgacagaagcttccaggaggattgatatacttcatgctgcttacatctaacttccagttgtgttttgtgcatttaacagacctggatggaaaattgtacttaggtttatgaaatggtgaaaataaatattaatctatttaaggcttaaatgcattattctgtgatcaaagtaaacgactgtagttggttgaacacaaaactcatgaaaggaaaaaaatagctaatattcaaatatccaaggaaatataaactcatcatcagtaggtgattttgaaagtgaagatattttttccttgtatttgatttttgtcagtttgatttgtatgtgactttgcacatttctccttgggtttatcctgtatgagactcttcgtgtttccctgacttgagtaaagtgaagataaacaccatggcacaaaataacgtgttagagatcagcagagccatcagaataaagtctgctttggagttccaactgtggctcagcaggttaggaacctgagcagtatccatgaggatgtgtgttcaatccctggcattgttcaatgggttaaggatccagcattgctgcaagctgcagtgtaggtcacagatgcagctcagatctggcattgctgtggctgtggcataggctggcagctgcagctctaatttgaccgctagcctaggaacttctatatgctatgggtgcagcccttaaaatttgtttttttttttaaagaataaagtcatctttaaggatgactctcatacaaaagctaagctgagtaagatccaagtggggccagtataaggaaataatgtagtaataaagattatctgtgatttaatagtcacactataacccttggcccctagtatagtgtactaaacctaagatcaactcaaattttcatttgtctaagaaaaaagacttcctgattgtttaaagatttctgatcatggttgccagataaaatacaggaaaaatataaatttcagataaataaaaaataattttaaaatgtcttacacaatattgaacatatattggaaatttgtttatctgtaattcaaatttaactactcagctttgcatttttatttgttaactctggcaacactgcttcagaatgagaatcagattaattgtagcaacaaaggaggcttagtaatattttttccatttcttaccagacggtgatagggatgtgatagttggagatagggcctaaaagttccatttcctctccatatttggtagtctgtctggctgtctttctttctttctttttgctttttagggctgcacctttctttttgctttttagggtggcatatgggggttcccaggagaggggttgaatcggagctgcagcaacaccatatccttaacccacttagcgaggccaggcatcaaacctgtgtcctcatggatactagttagattcatttctgctgtgtcccagtaggaactcccatattttggtagtgtttccagtcaagtttttttttaaacagttcaagattttttttttttttaacagacaaatatgtcttcaaccagaaatatcagattgtttaagctaacaatgtctattttcacttatatatcagtaaactatgctgattttttccaagcttcattacaatcaagaatttttaatgctcttttctagtaacaaggcagaaaacatattcaaacttcgacttatggaggatattttgtgacacttcctttctcatcaatgagtaactaacaactatcatggctcagaggttaacgaatctgactcgtatctatgaggacgagagtttgatccctggcctcgatcagtgggttaagaatccagtgttgccgtgagctctggtgtaggtcaaagattggctcgaattgtgcattgctgtggctgtggtgtaggccagcagctacagctcacattggatccctagcctgggaacctccatatgccatgggtgcggccctaaaaaaaaaaaaaaaaaaaaaaaaaaaaaaaaaaaaaaagatgaaataaataaattaacaaaaattgaaaacattccaaatgcagctattcagcaggctgggtcgttaaaggagaaatgtggcagtgtcacaactgctcatgggcagtaggcagaaaggagagagaggacagcttcatgtgccaagaggctgtgaaattagattgacaaaatgaggaccacagcttatgagagttcctgatcttgattatgtacaaagaagaaaaatggctgaggaagggaaggtggaacaggtaggtcactgcccttgactgtatcgtggaagagatatttcaggtgaattgctgcacagagagcctaagtagaagcagccaaatttggagagatggatgggggagtgtaccatgtaaactgctcttgggatggagtttcagcatataaatgcttggggagctgtatctgggagcaaagctgggtgaatctggctccccacctgcagcagagctaagatggtgccatctccatgttagcctgccaacagaataggttgaaactgggatcgttcaccccctaaggctttgggtgaaggagaggaagaccagtctgtggcaaagcaattaccatattaagctgagcaagccagattcaagaacagcctgaattcctgtaaagaacctctgttcctaagctacgcaagatcatggcagagtaataataatagcaaatgtaagtgacatttattgagcatgtatcatatgccagacattattttaagtgctttagtgtatgaaatcactccatcctctcagtagccagacagagaaggctttgtctactttcattttcactttatgaggaagaagagcgaggcccagaaaggctaagaaatgtgtccgaggtcacagagctgctaagtggtggagccaggcttctaaaccaagcagtttgcaaggaaagaccatgctcttaatcataaagctgcaacactcccttaaacaactggctaagacaacaccacaggacatggcccactaaggagaaaaaaggacagagaaaaagcagagtccccgggccacaagtcggaagacctcaaggcctgcacgtgcctgcagaagcttcttggtgacagaacaacctatggctgaggtctccctaacttgaaaccacccagaagatgcaagggactcaaaagcagtctgtcagcaaacaaccaagaggttcttccagagtaggctgcctaccaaaagtatgtcccatgcagtgcctgaaacatatctaactaaaaatatattcgttgtttatctgaaatgcaaatttgactgggcaccctctatttgcctaatctagcaaccctatctgcagagccaagcaagctacaggtatgacagcacttaacctgggagctgggccctgaagctaagtatgcagtgatgcaagtctgtgggccagtgtaagaagattccagacttgggtggtgatcttctatacagttagagcagggagttcttggacagctaccagttacctctgagtccattcgcactaaactgcccacagatgacctgagaaataagattgacgacacgacacggtggaagacaagcctaatatggaaacggctgaaacactacgagagtcaagttaggctgaagcaaagcttgaaagatggggtcaatccctcattcattatcagtggtgagcatcaggctgacaaaacacctccacccagaactccccctggctctgcaagctgtgctagctctttgtcaatcactgaaaagaaagcccaaccatcctatcctagaattgctcctgagatggggaggtaagcgatatgcaggtttaatcaaggggctggggaaaaggcgtaccagcactcgttcttccaagaaatgatcagaagagccgctgttgaggccaggtgcagctagagctctgccatttttcgggttttcatcagggaaagtctctctgttctagggcagtgtttggacaagcactcacctcacacacacacacttctgagagagcaggaaaggaaatccaaaagaggcttgagtctttgaatataaaagctggtaaacacacacacacacacacacacacacacacacacactccttagaagtttcactgtttatcaactaggaatacattttaaacaatagttcttcagagaggatgggaaattaagtcaaggtcataaatcaaaatcagagagctgccgtaaaggagcttaagaaaaagttaggcatgtgctgggggaaatagcatgttgattggatcatttaaaatttctcaatgagcacatttcctgccaaacctaattgggagaaaggatcgccagggagaaagcaaaggattctcagtaccttccatttagatcctcaatgtctttaatgaagaggcctccttggtgcttgcacatgttcttacatgccttcaggcggctcttattcttaaataagatgtaatccttgccagtgctcttatttcgaacaaaattgattccttccttgagattggcagcttcggcaggtgagaggcacaacaggatctccgtcgtttgttcgatg

SEQ ID NO: 15 - DNA, 1734 bp, Sus scrofa
atgagcagcatcgaacaaacgacggagatcctgttgtgcctctcacctgccgaagctgccaatctcaaggaaggaatcaattttgttcgaaataagagcactggcaaggactacatcttatttaagaataagagccgcctgaaggcatgtaagaacatgtgcaagcaccaaggaggcctcttcattaaagacattgaggatctaaatggaaggtctgttaaatgcacaaaacacaactggaagttagatgtaagcagcatgaagtatatcaatcctcctggaagcttctgtcaagacgaactggttgtagaaaaggatgaagaaaatggagttttgcttctagaactaaatcctcctaacccgtgggattcagaacccagatctcctgaagatttggcttttggggaagtgcagatcacgtaccttactcacgcctgcatggacctcaagctgggagacaagaggatggtgttcgatccttggttaatcggtcctgcttttgcgcgaggatggtggttactacacgagcctccatctgattggctggagaggctgagccttgcagatttaatttacatcagtcacatgcactcagaccacctgagttacccaacactgaagaagcttgctgagagaagaccagatgttcccatttatgttggcaacacggaaagacctgtattttggaatctgaatcagagtggcgtccagttgactaatatcaatgtagtgccatttggaatatggcagcaggtagacaaaaatcttcgattcatgatcttgatggatggcgttcatcctgagatggacacctgcattattgtggaatacaaaggtcataaaatactccatacagtggattgcaccagacccaatggaggaaggctgcctatgaaggttgcattaatgatgagtgattttgctggaggagcttcaggctttccaatgactttcagtggtggaaaatttactgaggaatggaaagcccaattcattaaaacagaaaggaagaaactcctgaactacaaggctcggctggtgaaggacctacaacccagaatttactgcccctttgctgggtatttcgtggaatcccacccagcagacaagtatattaaggaaacaaacatcaaaaatgacccaaatgaactcaacaatcttatcaagaagaattctgaggtggtaacctggaccccaagacctggagccactcttgatctgggtaggatgctaaaggacccaacagacagcaagggcatcgtagagcctccagaagggactaagatttacaaggattcctgggattttggcccatatttgaatatcttgaatgctgctataggagatgaaatatttcgtcactcatcctggataaaagaatacttcacttgggctggatttaaggattataacctggtggtcaggatgattgagacagatgaggacttcagccctttgcctggaggatatgactatttggttgactttctggatttatcctttccaaaagaaagaccaagtcgggaacatccatatgaggaaattcggagccgggttgatgtcatcagacacgtggtaaagaatggtctgctctgggatgacttgtacataggattccaaacccggcttcagcgggatcctgatatataccatcatctgttttggaatcattttcaaataaaactccccctcacaccacctgactggaagtccttcctgatgtgctctgggtag

SEQ ID NO: 16 - protein, 577 aa, Sus scrofa
MSSIEQTTEILLCLSPAEAANLKEGINFVRNKSTGKDYILFKNKSRLKACKNMCKHQGGLFIKDIEDLNGRSVKCTKHNWKLDVSSMKYINPPGSFCQDELVVEKDEENGVLLLELNPPNPWDSEPRSPEDLAFGEVQITYLTHACMDLKLGDKRMVFDPWLIGPAFARGWWLLHEPPSDWLERLSLADLIYISHMHSDHLSYPTLKKLAERRPDVPIYVGNTERPVFWNLNQSGVQLTNINVVPFGIWQQVDKNLRFMILMDGVHPEMDTCIIVEYKGHKILHTVDCTRPNGGRLPMKVALMMSDFAGGASGFPMTFSGGKFTEEWKAQFIKTERKKLLNYKARLVKDLQPRIYCPFAGYFVESHPADKYIKETNIKNDPNELNNLIKKNSEVVTWTPRPGATLDLGRMLKDPTDSKGIVEPPEGTKIYKDSWDFGPYLNILNAAIGDEIFRHSSWIKEYFTWAGFKDYNLVVRMIETDEDFSPLPGGYDYLVDFLDLSFPKERPSREHPYEEIRSRVDVIRHVVKNGLLWDDLYIGFQTRLQRDPDIYHHLFWNHFQIKLPLTPPDWKSFLMCSG

SEQ ID NO: 17 - DNA, 1328 bp, Sus scrofa
cttatagtaactttattaccttttttgtctgaacagttagtctttcttaatgtttctaggagagaacattagttttattttgaagagcacccactcagcgtatttgtcttacataacatgcagaacatgtatccacatttaaaaatttatctcattgtagtacatacttttacaaggtattccataaacactgaaaactataagaaacatatacatctaagaatcctactttatatagtctttcactaaataatactattttcatatacattttcaggtatttctagcttctcctgtgtatttagaattatgtatgtaatcaccaagagaatatgggccccttggaaggaaagcagtagaagcccacggagtaaagatctttctttaaaaagcaggttttattattgttttaaatacctcttggttatttgagattctaagaacttcgattaagtcccaaagtggaatgatcccttaataaccagacgataggaaaggtgaggaaagtgtcagtagcagggccaggacttggcacattcactaagaatgtagcacctcagtgtagcttatagtatagtgcctgggcagagttactgctcaacagctcgggatgatgaaccatctgctgccctgcaagtgtgggagcagctaacttggtgactgcaatccatggacagttagggcttgatgtatggtgtatgtagagagatgatggcagaggtagattctctccggcccatccttatcagtagtgccgtgattatgcttctctctgtgttcgaggagatcttttagacctgtaagaagagagggagagtgtgaaagactctggtttcagtctgagttctgcttggaacacactgaattcatagataatcccaagttctcaggtgaagtgtggtgagatttcctgctacacaatcattgtgtgttacaggggatcctttttaaaaaaggccaggaaaggcttgtgggaaatttggtatctttgcttggatagttataactctgcctcaaggttgaaatgacctattgacacttctagatagggaatcaggtgacttgatataccacataagatgacatctcagtatataagcacatgaaggtaatggcacagtggtggtaacactcttttaagccaaagattcccaggaaggcccaatgcaaatatttctaacttcccaaaattgacatttcttaaagagaaatacttctgcaagcagtagcaaacctacctttctttgctaattgctttcagtaaattcttgatggtcttagactctggattcagacatcttttctccccattctttttcattgtggca

SEQ ID NO: 18 - DNA, 1173 bp, Sus scrofa
acgcgggggagacactcttcaactgctcattctgagcctactgcagaagaatcttcagctgcagcaccatgaaccaaagtgctgttcttattttctgccttattcttctgactctgagtggaactcaaggaatacctctctccagaactgttcgctgtacctgcatcaagatcagtgacagacctgttaatccgaggtccttagaaaaacttgaaatgattcctgcaagtcaatcttgcccacatgttgagatcattgccacaatgaaaaagaatggggagaaaagatgtctgaatccagagtctaagaccatcaagaatttactgaaagcaattagcaaagaaaggtctaaaagatctcctcgaacacagagagaagcataatcacggcactactgataaggatgggccggagagaatctacctctgccatcatctctctacatacaccatacatcaagccctaactgtccatggattgcagtcaccaagttagctgctcccacacttgcagggcagcagatggttcatcatcccgagctgttgagcagtaactctgcccaggcactatactataagctacactgaggtgctacattcttagtgaatgtgccaagtcctggccctgctactgacactttcctcacctttcctatcgtctggttattaagggatcattccactttgggacttaatcgaagttcttagaatctcaaataaccaagaggtatttaaaacaataataaaacctgctttttaaagaaagatctttactccgtgggcttctactgctttccttccaaggggcccatattctcttggtgattacatacataattctaaatacacaggagaagctagaaatccctgaaaatgtatatgaaaatagtattatttagtgaaagactatataaagtaggattcttagatgtatatgtttcttatagttttcagtgtttatggaataccttgtaaaagtatgtactacaatgagataaatttttaaatgtggatacatgttctgcatgttatgtaagacaaatacgctgagtgggtgctcttcaaaataaaactaatgttctctcctagaaacattaagaaagactaactgttcagacaaaaaaggtaataaagttactataagccaaaaaaaaaaaaaaaaaaaaaaaaaaaa

SEQ ID NO: 19 - protein, 104 aa, Sus scrofa
MNQSAVLIFCLILLTLSGTQGIPLSRTVRCTCIKISDRPVNPRSLEKLEMIPASQSCPHVEIIATMKKNGEKRCLNPESKTIKNLLKAISKERSKRSPRTQREA

SEQ ID NO: 20 - DNA, 16125 bp, Sus scrofa
  modified_base (2290)..(2290): a, c, t, g, unknown or other
  modified_base (10685)..(10784): a, c, t, g, unknown or other
gcagtggacagtgcgccaccatggagttggggcctctggagggtgggtacttggagcttctcaacagcagtgccgaccctctgcagctctaccacctctatgaccggatggacctggctggagaagaagagatcgagctctgctcaggtgggccctcctccctctggcccttttcaagtccttccccagccctctgcctgccatggagcgctgctcagcaccacggacagctccagagcccgccccccgggggcgggctcctcgtggggacatctcccagcctgcccggctaccccctccttccccaccagccctctttcctggctctttcctgcttcatccaagtggcttttcctcccagaacctgacacggacaccatcaactgcgaacagttcagcaggctgttgtgcgacatggaagcagatgaagaaaccagggaaacttacgccagtatcggtgaggaagcattctgagccagaaaaaggacaagcgaggggaagaggcttcttttctctttggttaatctcacccactcaccaggagccagcaggccctacctcagaaatctgggccagggggatggggagtgagggctggaaggacggagaatcagggaagaagagagatggagaaggggagggaaatagaccccttcaccaatgaacaccaggcaattaagtcgcacttttacagagctcccattgtggctcagtggtaacaaccctgacgagtaaccacgagggtgtgggttcgatccctggcatcgctcagtggggttaaggatctgctattgccctgaactgtggtgtaggtcgcaggtgtggcctggatcctacattgccgtggctgtggtatagaccagcagctgtagctctgatttgacccctggcccagggacttccacacattttacatggggccctttaaaaaagacaaatctcacttttacatcctctgcctctatttctacatctttttctattagttgctcttctttccttccttcccacaaagcctatgtcatacaccgctccctctctcccaagctcccaagctaaactactctagtatttgtagtaactaccatttggggagcatttgcagcctgctaatcgctgtgcgtgtcttatcacattgaatccttacaaagacaaaggaagtagatattcttagtattttcactttacagatgaggcaactgaggtttagcgagataaagcaattcacccatgtctgcgttagagacagtaatgggcatgtctgaaattctaactgaggtcttatttttaaccacaaaaaccaaagtacctagggtggggaggtttgctaaggcttaatctaagaggctggtttgcagctttattgtttttttttttctttttagggccacacctgcagcatatggacgttcccaggctaggggtcaaatcagagctgcagcagccagcctgcaccacagctcatggcaacaccagatccttaacccacagggcgagcccagggatcgaagtcgcatcctcatggatactagtcgggtttactgctgccgagccacagtgggaattccttgtttgtagctttaaaaagagcgacacggatcccacgttgctgtggctgtggcataggctggcagctgcagctctgatttgaccgctagcctaggaacccccatatgatacaggtatggccctaaaaagacaaaaaaaaattaagagctgcattataaactacaacagaaaaaaatgttaaagactacatatgtacaactgaatcattctgctctacacttgaaactaaaacaatattgtaaatcaactatacttcaatttttaaaaagagcctcagctttcagtcaagggtagaactctttggggagaaaagtttctgttctgttgtgttttttgcggggtaggatggggtaaaggctctctccttaccagggacatcgctctcttatacagaggctttgttcaaatataaaaagatgctccttcttctggaggatggagcccccattaagaagtaacagcttgggagttcccgtcgtggcgcagtggttaacaaatccgactaggaaccatgaggttgcgggttccgtccctgcccttgctcagtgggttaacgatccggcgttgccgtgagctgtggtgtaggttgcagatgcggctcggatcccatgttgctgtggctctggcataggccagaggctacagctccgatttgacccctagcctgggtacctccatatgccacgggagcggcccaagaaatagcaaaaagacaaaaagnccaaaaaaaaaaaaaaaaaaaaaaaagtaacagcttggctatcaaagtgcagtctggatttctgccccttttgccctcttggctaggcccccttgtacagtgaacaaccttcacaactgtttttagtggcccttttcctggcaacccaggaacgacatcccttaggaggtctggcataaatgtggccagtctttccacagcacagagggcagaaaatggagaggaacagtaaccgtacgtgtctcaaaaattgcagaactgagagcctgcctgtttcctttcctttctgggaatttacttgctggaaggagaaatatttgggcctgagggtattcacagttcctcacaactggaggtagtaacgaaggatttgggctttttcccaagtcacttaggaggggggactttttccctttagaggcatctacacaggaagcgggagcatgtggaggaggcagcttcgcccaagtccgttcctcaaacctgtgctcctagaatctctggccaggtagtcatttgagcaaccttggcttctatagagataaactgggaataataatcccacctgcctcgtggaatgactgtttctgtgcataaagtgattagaacaggattttgcaaagagtgagcactcagtaagtgtcaggttccaccccaccacgaccaccaacaccgtcatgtcatcattatcatgtttgtcatcgtcttcatcaccattatatcttccctccatttcctcagcacagaagccttgtatggctccccactgcctataaaatcaagtccaaactttccccgacatgaaacttttaactgcagataccagtctctaagagtttcccaaacggctttcctccctctgtccccaccacccagaaagccctcctctttcctcctcgcagactctgccccatctttctttctttctttctttttttttttttttttttttttttttggtctttttgccttttctagggccgctcccacggcatatggaggttcccaggctaggggtctaatcagagctgtagctgccagcctacaccacagccacagcaacacgggatctttaacccactgagcgaggtcagggatcgaacccgcaacctcatggttcctagtcggattcattaaccattgcgcctcaatgggaactcctgccccatttttcaaagtctagctccaggacgtccttctctgggacatcctccctgattgccccatcccactttacaccctctcctgtatctcctgccatgataactgtcatcctgttggctccaagccaggttccacttcatacagtttacaactgcttactgagtgtcagctgtgtactgactactgtgttgactgctggaaaggcaaagcctatacgcctcaccatccatccctgaattgtaggcattacttgttctcatcacgtagaggaggaaacggggacctaactggcctaagtttgtacggctagtagggtgagtgaggggtagagctgaaatttaaactcaaacccaagacagctctactatactactggcactactttatagtactagatacacatcatccctctgattaggttaagagcccctgaagagtcagtgatcattcattcagcaaacctttatggacccccattgtgggccaggtctggacagtcatgactgcccaatgcccagcccaaggccaggcacacaataagcgtgaggtgaaaactcactgattgacggcacttttccttgtctggacagcggaactggaccagtatgtttttcaagactctcagctggagggcctgggcaaagacattttcagtaagttggggggtggggggttcttggttcagcctgcatttccttccttgttccttagggggcatggaaatacccagaggccacccttcaatgagaagtcacgttcccttcccagtgtagggacaatgagggctcatctcggacatcctctgactgtgtgtcttggtgtctttggttttttctctgaagttgagcacataggattggaagaaatgatcagtgagagcgtggaggtgctggaggactcagggcggaaaagtcagaaaagatgtgagtgagcgtgtttcccccccgccccctgccatccaacctctcctggcttcattcctggccctgccctggctctaaaacctcccagtcgcattccttgttaagccttgcctgctctgacctggctttgggtgtccccccacctctcctctcaccactgctccctcgagacccagagaggaagcaagtggcccagcagcagatggtccctctcctggtgggtctctgtttttgactgtcatttccaaaagacctctgggctctggcttctctttcatccttagttgtcacccctgtatttaagggaggtctcttcaaggacagtctttccccagcaagatctgggtttgaattccagatctgctatttaaggtctgtgtgaccttgggcaaataattacacctctctgagcctcctagtcagtctgcctgcctcctctgtctgtcctcacctggcagccaacatgggcttttgaatgcaaattcaatcatttggctggcctgcagaccctccaatggctcaaaatacataccacaaggatctgtaggatctggcccttccccctctccaaattcacgaatgtgagtcactatgctccatccagccacactggcttctttccattcctgtaactcttgtaccctttccagcctcagggcctttgcacttgctgttggccctgtctggaatgcccttcccccgtttcttcccatagtggcgcctccgaatcttgtaggtcttggccaacatgttgcctcctcccgaaggccttcttccatcaacttttccacataaattaaccttacttactttcaccttgtttgtgtctctccagcatcacagcccttgtcacaatctggacttgttttaggtattggcttttgcttagttcccccaccatggggacagggaccttgtctttcttatgtaatcactaccttccccagcacctggtacatgcctggcatgcgggagcatctccataaatatccactgaatggaaatttccaggagttcccatcgtggtgcagcagaaaggaatctgacgagtatccatgaggatttgggttcaatccctggcctcggtcagtgggtccagaaaccagcactgccgtgagctgtggtataagtcgaagatgaggctcagatcccgtgctgctgaggccttggtggaggccggcagcagccgatttgacccctagcctgggaatttccacatgcctcaggtgcagccctaaagagcaaaaaaaaaaaagaaaaaaaaatttccacaaaatgggcatcacagctaattgaatgcttactctaggccaaaccatgtgtaagccctgaacctatttaatttgaacaggtaaacagatgcatggcataaaaattcaaaaggtgcgaagaacagtcagtaaaaaaaaaaaaaaagaaaaaagagctccttcccactcgtttcccagtctttcattttccctctctgaagacaatctatgctgccagtttcctttttgtcttatattttgcctaaaagccagctctttaaaacaatgttgccccacaagtggcatttcacccaccgtctcgggcacctggctttcttcgtttaccacgtcaggacggcgatttccacaccacgatggaaaacacgtggtcctcccgcccaggaatttccctttcctttccttctttttttccttccttccccctttcttctttcttttcatttcataagcattttcccccaatattttaccatgtggtgtagggtgcagactacaaaatttctgtctttttttgcgtgtcttttagaccccaggctaggggttgagtccgagtgtaggtgccggcctacaccacagccacagcaatgcagagtctgagcctcgtctgcaacctacaccacagctcacagcaatgccagatccttaacccgctgagcgaggccagggagcgaacctgcgtcctcatggatgctagtcgggttcgttaacccctgagccacaacgggaactccgaaaaatttcagcatatagtagaggtgacagaattgtactacaagcaaccacatacccactgctgacaacctaccatcagtgttgggctatatttgccttaacacatctctatccatctgtccatccctctatcatccacccatccatccattttccaggggaacgtgtcaaaggacgttgcagacgccagtactgcccacacatccttccacatccttgttatttttagggctgcatggtatttcactgggggatgaatcatcgtttgtttcatcagcccctcgctaaggacacagctgggtttttctctgttgatgtgtgccgtgcttgatatgcactcactgatttccagtgcattcctgcaaaatgggaatcaacacccctgtttcacagatgagagaacaaaggctcagagaggctgtgtagcagagacaacacggccaggaagggcccaaaagcaggtggtttgtctttgttttttttgttttttttggtgggaggttgtttttgtttctgtaatggctgcacccatggcatacgtttccagggcagggattgaatctgagctgcagctgtggcaatgccggatcctttcacccactgcaccaggccagagatggaacctgtgccttcacagcgactcgggctgctacagtcaggttcttaacccactgtgccagggtgggatctcccacagatgtttttttcatttttattattattatttttaaactcaaactcttcctgtgtctcttctatggttctgcctcttccagtgcctcactgccctgggtgcttcaagatggggtttgggctcaagcaaaagagtgggggcagaaatggtcggaggaagaggagggaaagggaccccccaggccacttcccagccatttaaggcaaggccacaaggcctaactggggtccacaggcccgtcctggctgggtctgatgaccgtgtgttctctctgaagctttcccggaggagctgcctgcggatctgaagcacaggaagctaggtgagcagggcgggtgcatccagggagactgccaggcagggaagctggggtctcctcaggtgtgcatataaactagcatttaaaagctgaggctcagagaggtgaagccacttgttcaacatcacacagcaagtgagagttggagttgggattcagactaagatcatgaatccacagtgcgtgctctgcagttcaaggactgttgggagattcacctctacccacaaaacctattttgaactctgagtcagagctgaggacccccccaccccaccttgttccactgcccctccaggccacagctctcctttcggaaggcagcgtcacctctggtcagctggttacccggcggttcccccctcccatgcctcaatgagcctcttccccatgcctccatcccccccccaccagatgcttcctcccctcccttcctccctcctccctgattcggttgttattgcaaaggtggggaggccagctcccctgtgagaaagagactgagaaatgaaagcctcatagtctgatggaggaagcctggtctctactcccaggtctaatctgatggagaagacagggaccccaaccaggaggaccccagcgtgatggagacccccaatctgataggggaggcgagtctccgccctcctgagctcctgattcaatggaggagataaactcgtgccccagggagacagcaagtgctcgaggtccctggaggctatagaaggtggtaggggcctgggctaacaccctcttcttaggtgtgtcccgcctgcgcccggctctccaaggcaggaagtgctcagggaggaagccgggggtgggggctgtgtgacacagcacagttgctgctcagaccagcttcacccaggactgagaagaggacaggaattcccttccactgccagcagagagttccactctgctccctgagcactccccaccctgggaaggaccctcagggcacccacccagatcttaccaagcctctgacacggccccctttctcatagccgagcccctcgccatgcccatggtgactggcactttcctggtggggccagtgagcgactcctcagctcgaccctgcccatcacctcctgctctgttcaacaaggaatcaacacccagccaggcccagctggaggacgctgtcccaatgccgggtaggttaggggcttggaggggcagggcttccccttcccgcctccccgcaggtgcctgaggagtggctacttcaggagccacaagggacaggaactgctccccctactactgtcacccacttccatcccagccagtcctaccccccagggtccccctcgactccgtctgtgccagagaatgtgccctgggcatcacagcagggaatccctgccaaccagggaattcactgccagccctatgctagttcgcttgctttcctcagcagtgaaccgtgcaccctctctgggccagctgctctgctgggtgccagcaacactgtgctgggccagcagacaaagcttttcaatctcctccaggctctctcgattagagtccttgagaagggagtcagatgttaattaagatgctcaagtgctgggagtttggagttaatagatgcaaactattgccttcctgcgtggataagcaatgagatcctgccgcatagcacagggaactatatatctagtcagtcacttgtggtgggacatggttaaggatgatgtgagaaaaagaatgcatacatatgtacagctgggccactctgcagtacagtagaaattgacagaacactgtaaatcaactataatggaaaaaaataaaatctttcaaaaaaaaaaaaaacaaaaaacaaaaaagatgctaacggagaaccctaccttaccatcttggtctcttgcagcgcccccttcaggttccttgttgagctgcctgagtgtccctgctggacctattcagatcatccccacgctctccaccctgccccaggggctctggcacatctcaggggccgggacaggggtctccagtatactcatctaccaaggtgagcgtgggaagccaggctccccaccccctctgcctgtgacctgactattccctgacgccatccttttcccaccccaggcatttagtgcttacagcccagcaccttctcaggatcctccgtccccatttccccaaactcaaaagagaggagcaaagctcccgcgtgttctaagcgacccaagtgcctaagtgaccttttttggtcacttttctccacgaagccttagtttctcccttttaagaaaaataacttcattatactttaaaatccaaatatttatgtatgctcattaagaaaccaaaaaataagacctacttacaagagtcacggagtctccccatcgctctttttagtataccgttgtgaatagtttggtatggatccttgcacagctttctcaaagttgtcttgtttccgggtctgtaagaaggtccttgctgacctgccacattggagggttttaaattgtccaagggaaggcacgttgggctctcagggatgggagagagaatgaggctaaggagatatttccactcaactcaagagcatcctttgaggactttccactgtggcacagcagaaatgaatccaactagtatccatgaggatgtgggttcaatccttggcctccctcactgggttaaggatcctgtgatgctgtgagctgcggtgtaggtcgcagacacggttcggatcctgcgatactgtggctgtggtgtaggccggcggccgtagctccgaatcaacccctagcctgggaacctccatgtgccgcgggcatggccctaaaaagcaaaaaaaaaaaaaaacagtagaactgcgctgccgcttggctcacagtctccggttttacgggaatggggttagtttctgggtggtctatggccaattgtcttgcctgacccgtgcttggtccgcctcgcgcggggactttctgggtggcgcacacacctctcagccaagatggattccagcgccaaggatcctgggaagttggtggtctcctccctcccacaggcccctcccacgggcccctcccacatcctcccggttagtcttcagggcagcagcacattcctcacggggcctcctgtttcgagacacctcctgctagtggttgttatcctgcctggccgaggtggacagtttcggccagtcgtcccctaacagaagcacttgccctgctcccaaggagctggttgtgtcccttcacagatggggaaatcaaggctccgggagctccatgtcactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagagccagagctccagcagcttccaagtggccaggtgagtggtggcagggtccctctgcccaggtgctggacgtagaagcccaaatccgacttcccttcatgcattcacccaacacttgttcaatctctcttttgttggctcactcattcattcattcactcattcattcacatgctcattgcatcttcacatcatctcatcactcattcctctggttatacctacatttaaagctacctttaccgaggacctgccccggggaagcccatgctgggcgtcaatatctttttttttttttttttgtctttttttttgttatttctttgggccactcccgcggcatatggaaattcccaggctaggggtctaatcggagctgtagccgctagcctacgccagagccacagcaacgcgggatccgagccacgtctgcaacctacaccacagctcacggcaacgccggatcgttaacccactgagcaggggcaggaaccgaacccgcaacctcatggttcctagtcggatttgttaaccgctaagccacgacgggaactcctgggcatcaatatcttgttagcgaggctgagagagtgaatgaagggagcgtgggtgaccgagggaactaagacaggagtggggatgaaagggcagctgactgctgagtctgactctgtccctggtactccaacacaggagatgtagtaaatcaggaaagtcccaacctgactatggtccccattttgtggaggagaaaactgaggcacagtggggtatcgcacatgctcaagataatactagtaagtggtggagccaggacttaaaccagaaacatggattccactatcttaaccctcaacacacacacacacacacctccccagaatggtctcccaatcgtgagtgagcaaaagaagaaaatcttggagtgggtaaatgatggagaagatgagggaatgaatgagcgaatgaggcagctaatccagaaagccatcagggaagacgggtgaatggacgaagaagctagtgatggtggccgggctggcctctcggctgccctcctggtagccggtcctgccactagcatcctcccctcccccactcccgcctttgacctgtgcagagactgtggagcagttccaccactcactccgggacaggtaccaagccaagcccgcaggcccggaaggcatcctggtggaggtggacctggtgagggtgcggctggagaggagcagcagcaagagtcaggagagagagctggcctccctggactgggcagagcggcagccagcccgagggggtctggcggaggtgctgctggccgctagcgaccgccaggggccacgcgagacgcaggtgatcgccgtgctcggcaaagcaggacaagggaagagtcactgggcccaggccgtgagctgggcctgggctgacggccagctgccacagtacgactttgtcttctgcatcccctgccactgtttggaccggccggggaacacctaccgcctgcaggatctgctcttctccctgggcccacagcccctgcccatggacgacgaggtcttcagttacatcttgaggcggccggaccgcgttctgctcatcctggatgccttcgaggagcgcgaagcccaggacggcttcgtgcacagcgcgggcggacccctgtcctcagaaccccgctcccttcgggggctgctggctgggctcctccagcgcaagctgctgcgaggctgcaccctgctgctcacggcccggccccggggccgcctggcccagagcctgagcaaggccgacgccctgtttgaggtggccggcttctccgcacagcaggccaagacctacatgctgcgctactttgagtgtcggggggcccgtgagcgccagaagagagccctggagctcctccaggcacagccgtttctcctgagtcacagccacagcccttccgtgtgccgggccgtgtgccggctctcagagaccctcctggagctgggcgaggaggcagagctgccctccacgctcaccggcctctacgtcggcctcctaggaccagcggcccgcgaaagccccccgggtgccctggtgggactggccagactggcctgggaactgggccgccgtcaccacagcagcttgcaggagggccagttcccatcggcagaggccagggcctgggctgtggcccaaggcttggtgcagcgtgccccgggggccccgggggcccctgagctggccttctccagcttcctcctgcagtgcttcctgggggccgtgtggctggctctgagcagcgagatcaaggacaaggagctgccgcagtatttggcattaacccctaggaagaagaggccctatgacaactggctggaggctgtgccacgctttctggtcgggctggtcttccagcctcgcgcccgctgcctgggagccctggcagggctggtggcagccaccttggcggaccggaagcagaaggtgctcaacaggtacctgaagcggctgcagcccgggaccctgcaggcagggcggctgctggagctgctgcactgcacgcacgaggccctggattctgggctttggcagcatgtgctgcaggggctcccgacccaactctcctttctgggcactcggctcacgcctccggacacccacgtgctgggcagcgccttggtggctgcaggccgagacttctccctggacctccgcagcactggcattgacccctctggactggggagcctcgtgggactcagctgtgtcacccatttcaggtgggggccggggacaggagagagggcttctttgcattgagcacctactgtggttttgctgctgtgcccagtgctggctctgtggggtctcattcagtaggcatggcagccagatgtgggcagaagtgattccactcatttgaagatgaggaagccaaggctcagagagggagagtagcttgcccgaggtcacacagccagtgagaggcagcatcattcttttaaccactgtttgaaagggccatgttccaggcactgggccatgtctagagtctaagactgatctgggttcaaattcattttcttctctccatcccctgatcaagtcaccattttgtcatggttagattaaaaccacagcctcccctgacttccctgcccccgttctcgcctcttccactccattttattttattttattttattggtttttagggctacacctgtggaatatggaagttcccaggctaggggttgaatccgagctatagctgctgccctacaccacagccatagcaacgcaggatccttaacccactgagggaggtcagggattgaaccacatcctcatggatcctagtcaggttcgtcaccactgagccatgacaggaactcccccactccactttattcttaaccatcagagcaatctccctagtaattgcatctgatcatctttcatccttgcttacaatcttttagaggcactccacctccctcaggttgaagtcaaagttccttaatttaaggaatctaaatcctcctgtgatctgtttgatcccttaagccttatttccagagaatctctcctaccttccctctaagcatattttaccagagctataaggtctacaccattgtaatggttcaacggagaattcagcactgagcttcctggtagccaaagcaaaaaggaaaagaaaacccaggagagctaagaaaaaggaggaattgataagggcttaagtggtcatggaaggctttctagagaaagtagggggttaagctgagcaaagaaagtacctgaataggtaggaggtcccttcatggagttgcccatccgttatggtctagcccggtcaccatgcctgggtctgaggcccttcctccacagggccgccttgagtgacacagtggggctgtgggagtctctacagcaacgtggggagaccaagctactccaggcactggaggagaaatttaccattgagcctttcaaggccaagtccatgaaggatgtggaagacctgggcaacctcgtgcagatccagaggtgaggaggaaagggcacgggaggtggtccaggccatgcaggtccattacatttgtcattagcacttccagtgcctcatctttgggggatatcccatgtcctccgcttggacagtggccacccagaatctctcactgttgtcaccacccatgcagaactcccaggatttatcacttggtcccattaaaaacttgcagtcatgttcccaatttttttttttcttttttaggaccacaccttcagcttatggaagttcccagatgaggggtcaaatcggagctatagcttctggcctatgccacagccacagccacagcaataccagatccaagccacatctgtgacctacaccacagctcatggcaatgcttgattcttaactcactgagtgaggccagggatcgaacccgtgtcctcgtgtgtactagccaggtttgttacccctgagtcacaatgggaatccccctaattctttctcagctaaagccagggaactattctctgctgctaagagttcacgagctgccttctgcatctagtaacagaagtgacactatggccacctttcaaggcagccaggaccagtatcatccccatttttttgatggcagagatctaatgtctagtgggtagaggacacttgaccacagaacaactgcctttccctcattccttcatcatacattgttcgagcacctactatgtgctgtctgggatgggatgggtctcctctgaggctcttttccatgaaacacacaggaatattagccttcataacatcctgttctgaggcttttctttttaagaagggcataacaaggagttcctgtggtggctcagcaggttaagaacccagctagtctccatgaagacaggggttcaatccctggccttgctcagtgggttaagaatctggtgttgtgtgaactatggtgtaggtcgcagacacagcttgggatcccacgttgctgtggctgtggcgtaggccagcggctacagctccaagtccccccctagccttggaacttccttatgccacaggtgcagccttaaaaaaaaaagaaaaaaaagaaaaaaaagaagggactaaccatagcccgggaaaggcagtccttctggggaattttgggaatgtggcatgcatcttagtacatttaggaagggactcagcgacaggtgaaggtcccctgacattgcccattctctccatctctccaggacgagaagctcttctgaagacatggctggggaactccctgctgtccgggacctaaagaagttggaatttgc

SEQ ID NO: 21 - DNA, 4456 bp, Sus scrofa
ttttttcacttcacgttttggatgctgcaggccgggtaagcagagatcccaaggctctggcccccggggaagaggccctgtctccgagccctaccatgaaccacttccagaccatcctgactcaggtccggatgctgctgtccagccatcggccgagtcaagtgcaggcgctcctggacaacctcctggcggaggagcttctctccagggagtaccactacgccctgctccaggagcctgacggtgaggctctggccaggaagatctccttgacactgctggagaaaggagccccagacctggccctcttggggtgggtctggagtgcactgcagaccccagcagccgagaaggaccccggctaccaggaacctgatggcagtggacagtgcgccaccatggagttggggcctctggagggtgggtacttggagcttctcaacagcagtgccgaccctctgcagctctaccacctctatgaccggatggacctggctggagaagaagagatcgagctctgctcagaacctgacacggacaccatcaactgcgaacagttcagcaggctgttgtgcgacatggaagcagatgaagaaaccagggaaacttacgccagtatcgcggaactggaccagtatgtttttcaagactctcagctggagggcctgggcaaagacattttcattgagcacataggattggaagaaatgatcagtgagagcgtggaggtgctggaggactcagggcggaaaagtcagaaaagatctttcccggaggagctgcctgcggatctgaagcacaggaagctagccgagcccctcgccatgcccatggtgactggcactttcctggtggggccagtgagcgactcctcagctcgaccctgcccatcacctcctgctctgttcaacaaggaatcaacacccagccaggcccagctggaggacgctgtcccaatgccggcgcccccttcaggttccttgttgagctgcctgagtgtccctgctggacctattcagatcatccccacgctctccaccctgccccaggggctctggcacatctcaggggccgggacaggggtctccagtatactcatctaccaaggtgagatgacccaggccagccaagcaccccctgtccatagcctcccaaagtccccagaccggcctggctccaccagtcccttcgccccgtcagcagctgacctccccagcatgcctgaaccagccctgacctcccgggcaaacatgacagagggcagtgtgtcccccacccaatgctcaggtgatcaagaggcctccagcaggcttcccaagtggccagagactgtggagcagttccaccactcactccgggacaggtaccaagccaagcccgcaggcccggaaggcatcctggtggaggtggacctggtgagggtgcggctggagaggagcagcagcaagagtcaggagagagagctggcctccctggactgggcagagcggcagccagcccgagggggtctggcggaggtgctgctggccgctagcgaccgccaggggccacgcgagacgcaggtgatcgccgtgctcggcaaagcaggacaagggaagagtcactgggcccaggccgtgagctgggcctgggctgacggccagctgccacagtacgactttgtcttctgcatcccctgccactgtttggaccggccggggaacacctaccgcctgcaggatctgctcttctccctgggcccacagcccctgcccatggacgacgaggtcttcagttacatcttgaggcggccggaccgcgttctgctcatcctggatgccttcgaggagcgcgaagcccaggacggcttcgtgcacagcgcgggcggacccctgtcctcagaaccccgctcccttcgggggctgctggctgggctcctccagcgcaagctgctgcgaggctgcaccctgctgctcacggcccggccccggggccgcctggcccagagcctgagcaaggccgacgccctgtttgaggtggccggcttctccgcacagcaggccaagacctacatgctgcgctactttgagtgtcggggggcccgtgagcgccagaagagagccctggagctcctccaggcacagccgtttctcctgagtcacagccacagcccttccgtgtgccgggccgtgtgccggctctcagagaccctcctggagctgggcgaggaggcagagctgccctccacgctcaccggcctctacgtcggcctcctaggaccagcggcccgcgaaagccccccgggtgccctggtgggactggccagactggcctgggaactgggccgccgtcaccacagcagcttgcaggagggccagttcccatcggcagaggccagggcctgggctgtggcccaaggcttggtgcagcgtgccccgggggccccgggggcccctgagctggccttctccagcttcctcctgcagtgcttcctgggggccgtgtggctggctctgagcagcgagatcaaggacaaggagctgccgcagtatttggcattaacccctaggaagaagaggccctatgacaactggctggaggctgtgccacgctttctggtcgggctggtcttccagcctcgcgcccgctgcctgggagccctggcagggctggtggcagccaccttggcggaccggaagcagaaggtgctcaacaggtacctgaagcggctgcagcccgggaccctgcaggcagggcggctgctggagctgctgcactgcacgcacgaggccctggattctgggctttggcagcatgtgctgcaggggctcccgacccaactctcctttctgggcactcggctcacgcctccggacacccacgtgctgggcagcgccttggtggctgcaggccgagacttctccctggacctccgcagcactggcattgacccctctggactggggagcctcgtgggactcagctgtgtcacccatttcagggccgccttgagtgacacagtggggctgtgggagtctctacagcaacgtggggagaccaagctactccaggcactggaggagaaatttaccattgagcctttcaaggccaagtccatgaaggatgtggaagacctgggcaacctcgtgcagatccagaggacgagaagctcttctgaagacatggctggggaactccctgctgtccgggacctaaagaagttggaatttgcgctgggccctgtcttgggcccccaggctttccccaaactggtgaggatccttgaggccttttcttccctgcagcatctggacctggactcgctgagtgagaacaagatcggggacgagggtgtcgcccagctctcagccaccttccctcaactgaaggccctggagacgctcaacttgtcccagaacaacatctccgacgtgggtgcttgccagctggccaaggccctgccctcgctggccgcgtccctcctcaggctgagcttgtacaataactgcatctgcgatgtgggagccgagagcctggcgcatgtgcttccagacatggggtccctccgggtgctagatgtccagtacaacaagttcacagccgccggggcccagcagctcgccgccagcctgagaaagtgccctcacatggagacgctggcgatgtggacacccaccatcccgtttggtgtccaggaacacctgcagcagcaggactcaaggatatcctgagatgatccaggctgcacccgggacaagcacgttctctgaggacgctgaccacgctggaccctgacctgatcatctgtggacacagctcttcttaggctgtgtcccgtgagctttggcgatctggtgcccagccctggtggctcagagtcagcccccactctgctggggaaaggacccacggcctgctctgtggacagaccccaggcccggccccaggctccttcggggcccagactgatgtcagccttgctcagccgctgcagtcctggcagacaggcgggcacccagtggcagsyagggkccacccgggagccctgaagcactccctgcaggacactgcagacagtggtggccaggtcagagtgagggatgtggcggccacatcacctgcccaggtcctgctggccgggggagaaagcacctctccacactgctcccctggtggggtaagcttggcgctcagaagataccagccagcaccccccagcgtgttgatttcccaaacggtgaccgacggggtgtccacggcagctgccctctgcctccggcacctgcgggtttgcactcactttgtttgccgaggccaaagctgggcctggccagacacgccrgaccttagcgggggaagagccgacagtacactacgggmcgaggyrgggtggcgagggtctggaaccacatccgccttcttgccctcacgtcctgtgtcttttttcactacattatacatggcttattcagtctca

SEQ ID NO: 22 - protein, 1204 aa, Sus scrofa
MNHFQTILTQVRMLLSSHRPSQVQALLDNLLAEELLSREYHYALLQEPDGEALARKISLTLLEKGAPDLALLGWVWSALQTPAAEKDPGYQEPDGSGQCATMELGPLEGGYLELLNSSADPLQLYHLYDRMDLAGEEEIELCSEPDTDTINCEQFSRLLCDMEADEETRETYASIAELDQYVFQDSQLEGLGKDIFIEHIGLEEMISESVEVLEDSGRKSQKRSFPEELPADLKHRKLAEPLAMPMVTGTFLVGPVSDSSARPCPSPPALFNKESTPSQAQLEDAVPMPAPPSGSLLSCLSVPAGPIQIIPTLSTLPQGLWHISGAGTGVSSILIYQGEMTQASQAPPVHSLPKSPDRPGSTSPFAPSAADLPSMPEPALTSRANMTEGSVSPTQCSGDQEASSRLPKWPETVEQFHHSLRDRYQAKPAGPEGILVEVDLVRVRLERSSSKSQERELASLDWAERQPARGGLAEVLLAASDRQGPRETQVIAVLGKAGQGKSHWAQAVSWAWADGQLPQYDFVFCIPCHCLDRPGNTYRLQDLLFSLGPQPLPMDDEVFSYILRRPDRVLLILDAFEEREAQDGFVHSAGGPLSSEPRSLRGLLAGLLQRKLLRGCTLLLTARPRGRLAQSLSKADALFEVAGFSAQQAKTYMLRYFECRGARERQKRALELLQAQPFLLSHSHSPSVCRAVCRLSETLLELGEEAELPSTLTGLYVGLLGPAARESPPGALVGLARLAWELGRRHHSSLQEGQFPSAEARAWAVAQGLVQRAPGAPGAPELAFSSFLLQCFLGAVWLALSSEIKDKELPQYLALTPRKKRPYDNWLEAVPRFLVGLVFQPRARCLGALAGLVAATLADRKQKVLNRYLKRLQPGTLQAGRLLELLHCTHEALDSGLWQHVLQGLPTQLSFLGTRLTPPDTHVLGSALVAAGRDFSLDLRSTGIDPSGLGSLVGLSCVTHFRAALSDTVGLWESLQQRGETKLLQALEEKFTIEPFKAKSMKDVEDLGNLVQIQRTRSSSEDMAGELPAVRDLKKLEFALGPVLGPQAFPKLVRILEAFSSLQHLDLDSLSENKIGDEGVAQLSATFPQLKALETLNLSQNNISDVGACQLAKALPSLAASLLRLSLYNNCICDVGAESLAHVLPDMGSLRVLDVQYNKFTAAGAQQLAASLRKCPHMETLAMWTPTIPFGVQEHLQQQDSRIS

SEQ ID NO: 23 - DNA, 45862 bp, Sus scrofa
cacatgaactggacaggccccaggtacataagaaaaaggcccctagtccagtagccaataggattcctcctttctgaaagtcacagcgcttttccttcctgagcagagtgggggcgggggaataaagttgcggccacagagtggacttgagctccccctggaggcccaaacgattatttgcaccaacttgtcctggcttttggagttgagcgggaagaatccgagggtcttcattcaccgtcctggaaggatagttttgtcagtggttttggtccaggctgctcggttgtgcctgaaaagtcacggctgaagggagcgctgtgtgacggttattgtttgtgccttgacttttgcttccaaatcagcccaaaagaaactctgctttttttttttcttttctagggccaaacccatggcatatggaagttcccaggataggggtccaatcagagctgtagccgccggcctacaccacagccacagcaacgccagatccaagcctcgtgtggagactacaccacagctcacggcaacgccgggtacttcacccactgagcaaggccagggatcgaacctgcaacctcatggttcctagtcggattcgttaaccactgtaccacgacaggaactccaccctttctgttttgaaaggcacacagacaaagaaaacagtcgtatttattattctggacactttgcttctaagtcataggaagcaactcagattaggttaaagaaaaatggggaattataagggcactgtgttttataaaatcccagggcaggactgtagccagagctcaggaaagaaccagaaggttttcagaagtctctcatttcagctcagtggttaacaccctccgagagttccattttaactttgctgtggtggcacagcagaaccctctccccaaggaaggtgacaggaacgtccttaaaatgaggaagaaccgcatggcccaatcaccctctctacacgtatgcacagcccagactgtacccaataagactgcaataaggctatatgttaccatataaaggggacaaaggggtaaaaataatataaaaggcatctcctcactgtgctcagggctcagcctttggacatgaatctgtcgagccagtgccggcatgaataaatactgcttcctggaaaaaagccttggtgggtgtcccatctctgtacgtaagtcctacaacagttccttcctgctagagtagaaggttccagatcctggggcagggaagaggttcctagaacctactgatgataactacagcacatcaaaacagtccctgctgggggatgttggagcatgcaacaactgccatgaaagtggacaactctatctccctgtatcaagagtgcatgtttcaggagttccctagtggctcagagggttaagaatctaactaatatctatgaggatgcaggtttgatccctagaatagttcagtgggttaaaggatctggtgttgcagtgtagatcaaggatgtgcttggatctggtgttgctgtggctgtggcacacactggcagctgtagctctgattcaacccctagcctgggaacctccatatgccgagggtgcagccctaaaatgacaaaaacaagaaaacaggaatgcaagtaagtcaggagttccctggtggttcagtgggttaaggatctggcattgttactgctgtggtgagggttttattcctggcccaggaacttctgcatgccacaggcacagccaaaataaataaataaataaataataaattaagtggagttcccgtcgtggcgcagtggttaacgaatccgactaggagccatgaggttgcgggttcggtccctgcccttgctcagtgagttaatgatccggtgttgctgtgagctgtggtgtaggtcgcagacgcggctcggatcccacgttgctgtggctgtggcataggccagtggctacagctccgattggacccctagcctgggaacctccatatgccgcgggagcggcccaagaaatagcaaaaagacaaaaaaataaataaattaaataaataaataaattaaataaattaagtaaaatttaaaatttctaggagttccctgatggtctggaagttaaggatttggagttgtcgctgctgtgactcaggttgaatctctggcctgggaacttctgcaggctgtgggcacagccaaaaaaaaaaaaaattaagacaaaaaaacaaagcaaataattcatcaggaaggcagaaattttttggaagcagacctaggagaaaataaatatttgtttaaatatgtaaatgtttatttatattttaactattttatatatttaactttccttttttttttttttttttttttgctttttagggccacacctgaattatatggaaggtcccaggggaggggtcaaatcagagctgcagctgctggcctacaccacagccacagccactcgagatccgagccacgtctgcgacctacaccacaccacagctcacggcaacgccagatccttaacccattgagcaaggcgagggatcgaaccttcaatatcatgattcctagtcagatttgttaaccactgagccatgacaggaactccagtcatcttttgttttgaggacataaagtaagaggtatagagaagcacttccccaggggtctgaacaatgtataggctatttagggaaacaggtggttattataactggaggtttgtactttttttttttggtctttttgtcttttctagggccaaacccatggcatatggaagttcccaggataggggtccaatcagagctgtagctgccggcctacaccacagcccatagcaacgccagatccaagccgcgtgtggagcctacaccacagctcacggcatcaccggatccttcacccactgagcgaggccagggattgaacccgaaacctcatggttcttagtcagattcgttaaccactgagccacgatgggaactccagaagtttgtaccttttgaccaccttcaacgaggggctatttagggaaacaggttatgttgtcccagtgctgagccctagatcccgagatgcccaaatgttcatcagtaaatatatgtgttttttttttttttttttgccacaccagcagcacgcagaaggttctgggccagagatccaacctgatccacagcaccgacaatgccaaaccttaaccactaggccaccagagaactcctatgtatttttttcttccagtttataattcacctacagcactgaatgagttgtagagcataatgactggacttgcatacgtcatgaaatgattaccacaataagtttagtgagtgagttcccactgtggctcagcagtaacgaacctgactggtatccatgaagatgcgggttggattcctggcctcgctcagtgcgtttaaggatctggcattgctatggctgtggtgtaggcgggcagctgcaggtctgattcaacccctaggctgggaacttccatatgccacagatgcagccttaaaaaacacataaaaataaaaataagtaagtttagtgaacatccattagctcacataaataaaaaattaaatagaaaaaaattttcgttgtgatgagaacttataggatttattctcttaaccactttctttctttctttcttttttttttttttttgtctttttgccatttcttgggccgctcccacgacacatggaggttcccaggttaggggtccaatcagagctatagccgctgacctacgccagagccacagcaactcggacggaatccgagccgagtctgcaacctacaccacagctcatggcaatgccggatccttaacccactgagcaaggccagggatcgaacccacaacctcatggttcctagtcggattcgttaaccactgagccacgacaggaactccagactcttctttttttttttttttttaagggctgaactcgaggcatgtggaggttcccaggccaggggtcggatctgagctgtagctaccggcctataccacagccacagcaacacaggatccgagccacatctgcgacgcacatcatagttcacggcaacactggatccttaacccactgagcaaagccagggattgaacctgcgtcctcatggatgctagtcagattcagttctgctgaacaatgatgggaactccccatgctgactcttaagataacagagagagcctgcctcatcatgatggccagattctgtacttgacatgggtcttgaatggtcagcaactgatctcaaggccctggaatttagtggcttagccttacactggcacctcagcagagggtcccagatcaatcccaggcattctagtaggtgtcctttttttttttttttttggtctttttgccatttcttgggccgctgctgtggcatatggaggttcccaggctaggggtccaattggaactgtagccgccggcctaccccacagtctcagcaacgcgggatccgagccgtgtctgcgacctataccacagctcacggcaatgccggatccttaacccactgagcaaggccaggaatcgaacccgcaacctcatggttcctagtcggattcgttaaccactgagccacgacgggaactcctcttttttctttttaatggctgcacccacaccatatggaagtgccctggccaggggtcaaactggagctgcagctgctggtctacaccacagccacaacaacactggatccaagctgtatctgtgacctactccacagctcgcggcaacgccggatctttaaccaactgagtgagaccagagatggaacccgaatcatcacagagactgtgtggggtcttaatccactggaccacaatgggaactccgagaatatgcctttatggtagggagtctgacgcctgggaaacctttattctggcagggcgtggtttaccgcagtgatcgcctccctctaattgcctgcatcccatccctgtgccgggctccaggtgagctgactccacagagctctcctcacctgccggggcccttgtgacttctctcttctctggtcccccaaccctgctgctcaatcctactagcggactgaaccgaacgaggctgccacctcctcaaggcaaggaccctgggttcttcacattatttgagtccacaaggtaggaccaaaggaaaatttgtggaggacagtgatgctggagatgatctgtgatataatttccagcaagtaaccttcaaggacccagcagccatcttttttttttttccactgtacagcaaagggatcaagttatccttacatgtatacattacaattacattttttcccccaccctttgttctgttgcaacttgagtatctagacatagttctcaatgctattcagcaggatctccttgtaaatctattctaagttgtgtctgataagcccaagctcccgatccctcccactccctccccctaccatcaggcagccacaagtctcttctccaagtccatgattttcttttctgtggagatgttcatttgtgctagatattagattccagttataagtgatatcatatggtatttgtctttgtctttctggctcatttcactcagtatgagagtctctagttccatccatgttgctgcaaatggcattatgtcattctttttaatggctgagtagtattccattgtgtatatataccacatcttcagaatccagttatctgttgatggacatttgggttgtttccatgtcctggctattgtgaatagtgctgcaatgaacatgcgggtgcatgtgtctcttttaagtagagttttgtccagatagatgcccaagagtgggattgtggggtcatatggaagttctatgtatagatttctaaggtatctccacactgttctccatagtggctgtaccagtttacattcccaccaacagtgcaggagggttcccttttctccatagcccctccagcacttgttatttgtggatttattaatgatggccattctgactgatatgaggtggtatctcatggtagttttgatttgcatttttcttataatcagcgatgttgagcattttttcatgtgtttgctggccatctgtatatcttctttggagaaatgtctattcaggtcttttgcccatttttccattgattgattggcttttttgctgttgggttgtataagttgtttatatattctagagattaagcccttgtccattgcatcatttgaaactattttctcccattctgaaagttgtctttttgttttctttttggtttcctttgctgtgcaaaagcttttcagtttgatgaggtcccatgggtttatttttgctctaattcctattgctctgggagactgacctgagaaaatattcatgatgttgatgtcagagagtgttttgcctatgttttcttctaggagtttgtcctgtcatatatttaagtctttcagccattttgagtttatttttgtacatggtgtgagggcgtgttctagtttcattgctttgcatgcagctgtccaggtttcccagcaaccagcagccatctttttgactgaagatacactcttcccagtgagatggaatcagatgatgggagatactatatgtacaaatgcttcccacatagtaaggcatcataacacagtaatttttgtttattcttttttggtcttttttttttttatggccacacacttagcatctggaagttcccaggctagggggcgcatcagagctgcagctgccagcctatgccacagccacagcaatgccagatccttagcccactgagcaaggccagggatccaactcgcatcttcgtggatagcagtctggattgctacctctgagccatgatggaaactccgccgtaatcgttatgaatgaagtctccattgcccacctcagtgactggtccatttctaatgaccctgtacttttattggtacttccagtaacggagtcagacccacctgcctaccctgctccctgggcattacaatgcttatcttatgaggagttcaaatattggtatcccagccaccgcatccgctgacttagatacttgcaaccaggcagctcagcgcttttccaatgcccagataccttaggtggcacattggagatagttcttgaagtagtggagagccaacttgaatttgatctgggcttcggtgttggcccgataactggtgtagttcccctccagggtggccagctctgggtccatcactggtaaatggggctggtgacctatgatcacatgtgggcaggaccccacgagcaggctcccgagcccatcaataaagaactctgccaagagagggagagagcgcgagaaggaaacgtgagcttcaaaccagagacccgggccaatactgcgactctgggaggagggctggggtggggggggacatagcttctattctggggaggttcagtcccatggcaaagccactgagttggaagatcagacagatatcagcagagagacacagattagcagaccccaggactgggaggaatgagaggggaagaggtggggtgctgctcaccagctgcagctaaacagagaaggatgtctggaaaaggaggagcaggaaattcccgtcatggcgtagtggttaatgaatccgactaggaaccatgaggttgtgggttcggtccctggcctcgttcagtgggttaaggatctggcgctgccctgagctgtggtgtaggtcacagaggcagctcagatcccgtgttgctgtggctctggcataggccgggagcaaaagctccaattcgacccctagcctgggaacctccacatgccatgggtgcagccctaaaaaggcaaaaaaaaaaaaaaaaaaaaaaaaaaaggcaaaaaaaaggaggagcagcagcaagacaaggaaagagggaaggggcagagctgcagggagaggaggtagaagggtgtctcggagaagcaggaatagcctatgggagacacgaaggtggagggaggcaagagagaccaagagctccctagtttggggagaaggggctgcttccctgagcagcagggccccgccctccctcagaaagagacttctgaagccagcgcacagcccagctcgcttcttgcccttccagcctccccacctgagtgagccactcgctgcagccgggggtcgaagccaattctttggagtcgctctgtgtgagccaggaagaagttgacaacaccactggtcaccacgcagtcggggaagccatccacgggccggaaaaatcctggctgctggtggagacagtcgccattcttcccctgctccagcaacagcttgaactggaatgtgttttcaatcacgctgccacctacctagccagcgggaggagaaatctgttagagaacagactccatatccaaggagcctgtgccaggaagccttactggactgaacctcagtcacgacaagaattgcactccctggagttcccgttgtggctcagtggttaacgaatctgactaggaaccatgtggtttcgggttcgatccctggcctccctcagtgggtgaaggatccggcgttgctgtgagctgtggtgtaggtcgcagacgtggctcgtgagctgtggcataggctggtggctacagctccaattggacccctagcctgggaacctccatatgctgcgggagtgacctaagaaatggcgaaaagaccaaaaaaaaaaaggtaataataataataaaataaaataaaataaaaaagaaaaagaattgtactccctgtcttatctacccttcatgttacacttccgccaagtccaaagggcagcaaagtttctgctgcacttaccctccagcaagctcactctttccagagggccactccctcccctcccttctgctacaaggatccaggaggatcgaggatgggggatcgcgtttgggtgcaggtgagaggcagccagcgtgcagccgtccctacgtggacttcctgagcaagcctttgtctcaagttgtctccctcccattctctgcccctggctcacttctctgcgccgtctgtccacacaccacacactcctgggagctcgcagctttgtgtgagcccgagcacagcaggacaagcaagtacatctattcctgaaccatcataatcacctagggaggcagagcagaatctgccagttgccccccaccccctcgcctgttctttccttcctcctcttaggaaatgagccccctgaggtgttttttggtttttgtttttcctttttcagctgcccctgcagttcccaggccggggatggaatccaagccagagctgcacccaccccacccccacgcagcaacgctggatacttaatttaacccacggcacaggactggggattgaatgggcacctccacagagacaaactggatccttaacccccatgccacagtgagaactccaaactccaaaccctctgagatttaagtggactaaattaagcgacaatgatcctacgaaagatgaaatttccccacttctctggagttcccaatgtggctcagcggtaatgaacctgaccagtatccatgtggacgtgggttcactccctggcctcctcgagtgggttaaggatccggcattgccgtaagctgtggtgtaggtcacaaaatcagctcaggtcccatgttgctatggctgtggtatagacgggcagctgcagctccaacgggacccctaggttgggaacttccatgtgccctacaaagaagaagggaggaaggaagggaaagagggagggagggaaagaggagagagagggagggaggaaggaaggaaggcagggagaaatggcccacagcatatggcttgaatcccagctgcagctgcagcaatgccaaatcctttaacccgctggactgaaccagcacctctgcagcaacccgaaatgctgcagtcgggttcttaacccactgtgtcacagtgggaactccctgaaaggatgtgatttagaacagatgtctccaatttttaaaaagaccacattcttctcatcttttcctttttttttttttttttttttggcttcttaaggttgaacccacggcatagggggttagtggttagtttccaggctaggagtcaaattggacccacagctgttggcctacaccacagccacagcaacgccagatccaagcctcgtctgtgacctataccatagctcccagcaatgccagatccctgacccactgaacaaggccagggatcgaacccacatcctcatggatactagtcagattcatttctgctgcgccacgaagggaactcccaagaccacattcttaaaagaaaactgttgtcttctactccctctctccccctttcttctgaccgtgcagctgagggccacaaagatggatgaacaacagggaaggaagctggaccaggatgaccctggaaagagacaatagggccagcttgcattctctctttttttttttttttttttttttttggctttttgctaattcttgggccgctccagcagcatatggaggttcccaggctaggggtccaatcggagctgtagccgccggcctacgccagagccacagcaacgcgggatccgagccgcgtctgcaacccacaccacagcccacagcaacgccggatcgttaacccactgagcaagggcagggaccgaacccgcaacctcctggttcctagtcggattcgttaaccactgcgccacgacaagaactccccagcttgcattcttacacgggtaggaactgcaccttttttgtcatttatgctattgtgactgggtctctagaagagtagcaaagagacatcttcgtcaatccagatgttttgggggactgtccacctggaataagagataactgtggtcacggtgctacttatccactttctttccaggccgggatagaaccagcaccacagcagtgacaatgctggatccttaaccctatgagccaccagggaactcccatctttctttttccaaacagctttattgagatatctttgatatattaaaactgtatgaaggagttcctgtcgtgtctcaatggttaacaaatccaactaggaaccatgaggttgcggattcgatccctggccttgctcagtgggttcaggatccagcatttttgtgagctgtgatgtaggttgcagacgcggctcggatcctgcgctgctgtgtctctggcgtaagccggtggctgcagctccgattggacccctagcctgagaacttccatatgccgcgggagcggctcaagaaaatggcaaaaagacaaaaagacaaaaaacaaaacaaaacaaaacaaaacaaaacaaaaaactgtatgtattgaaggtgtacagcttgatttttttttttttttttggtctgtggcatgtagtggcttgatgcaggatctcaattcccagaccagggactgaacctgggccacagtggggaaagcaccaaatcctaactactacaccaccagggaactccctgcagcttgatgttttgatatatgtagacactgtgaaaagatcaccacacgcaagctaattaatgaattcatcacctctacacagtgtgggtatcttcacaaatttcaagaacgcaatgcagtattattaactattcatcaccttttttcccccttttccatgtgtaaattaacttttgatatttgtggggttttttgttctgttttgttttgtctttttagggctgcacctgcagcatatgaaagttcccaggttagcagtccaattggagctgcagctgccagtctacgccacagtcactgccacagccacagaaatgccagatctgagccacgtctgggacacacaccacagcttatgcaacaccagacccttaacccactgagcaaggccacggattgagcccacatcctcatggacactagtcgggttcattactgctaagccacgacgggaactcctgtgttaattttttattgtcattaaggccacgtgtgcttttatagctttgtgccattttcatttttgtgatggtgtgtgacaaaaccagagcagcactcacattcctctccaactctcaccagtccagagaggaagttggaagtgatgcatacaaagaaaaccacagctttcaaaagatacacgcaccccaacgttcacggcagcactattcacaatagccaagacgtggaaacaacctaaatgtccatcaacagatgagtggtgtacacacacacacacacacacacacacacacaatggaatattactccctcatgaaaagagtgcaataatgccatttgcagcaacgcagatggacctagagattatcatactgaatgaattcagagaaagacggatatcatatgatatcccacatatgtggattcaaaagagatacaaatgaacttatttaccaaagagaaacagactcatagatttagaaaacaaccttatggctaccaaaggggaaaggtggctggcgtggggagggggtggagggataaattaggaaattgggattaatatatacatactaccatatataaaatagataggagttcccattgtggctcagtgagttatgaacccaactgtgatccatgaggatgcaggttcaatccctggctttgctcagtgggttaaggatccggtgttgctgtgacctgtggtgtaggtcacagatgcagctcaggtctgatgctgctgtggctgtggtgtaggccagcagctacagctccgatttgacccctaacctgggaacctccatatgcctcggatgcagccccaaaaagaccaaaaaaaaaaaaaaaaagataactgacaaggacctactgtatggcaaagggaagtacacgcaattattctgtaatttcctacgtgagggaaggaatctgtaaaagaatgggtatagctgaatcactttgctgtacacttgaaactgatacaccatggtaaatcaactctactccaatagaaaatacaaattagggttttataaattttataaaaataaaataaaacctaggccacctggtggcctagaggttaaggatccaacattctcactgctgtggcacaggcgggatcaggctggatccctggcctgggaacttctgcatgacataggtgtggccaagcaaaaaaaaaaaattcaattaaaaaaaatgactgggagttcccattgtggctcagtgattaagaaacccaactagtaaccatgaggttgcaggtttgatccctggcctcactcagtgggttaaggatctggccggcattgctgtaaagtgtggtgtaggccagcagttacagttccaactggacctctagcctgggaacctccagatggggcaagtgtggcactaaaaagacagaagacaaaaaaaaaaaagattgaaaaaagtgcctaaacacacttttttcttttgccatttcttgagctgctccctcagcatatggaggttcccaggctaggggtccagtcggagctatagccgctggcctatgccagagccacaacaacgggcaattcagccgcatctgcaaactacaccacagctcacagcaatgccggatcctgaacccactgagcaaggccagggatcgaacccacaacctcatggttcctactcggattcgttaaccactgagccacgacgggaactccacaacacactttaaggacagaacaacggtgagtctggggagtggggttggtgtgatttgttcaaagaaaagtaagaatggaggcagaagcagaatccgagggtctcatttccgtgcgagagtctcaatcccagagctgctctgcatcacctcctgcacggcccttccccttccgcctccctcttccccccccccccacccccgtcccttttcctctcctctttcctcctgtcctttcctctctgccctctcctccccctccccctctggctcgtcagatggcaatggggtagaactggcagcgctcagctcacttaccacgtccagttccgttttctctaggacgtccaccagcgcctcgatcctggtcttgctgttgaagatgaagtcatcgtccacccagagcacatatttggtggtgacctgagatatggccaggttcctgccagcaaaccagccctgcgagggcagggaggttagacccgtggttgcccgccccgctgcctcctagcatcacctgggggctttctcagctcccaagggtcaggctgccccccagacagtggctgagaacctctgggctaaagggagtccatgtctcagagaccctggaagaaggagagggactctctggagacgagaaagtccctccttggccctgtggcttgagggatggatgcaagtccctttacacctgacagtctttgtggccctttcgccctgtgttgcctggaagatgctggagggtggggctctctggaaggggtaacatccacttcctcccggtgtgctcgagggaaggtgtggggcgcggagagagacaccccagcaagggtgaaatcatgacagaggtttctctgctgtgggacctgcgtatcaggaaaccttagagcgtcagacaccgccagtcgcttacaaggacctccatcaatttccacaccaagcgtgaggaaagacagattacccaccccgtcactgcaggaaagggagagtgacctgatttctccgggaatttggaggcagccaggggactcagaggagtccccaccccccgccccccaaggatcctgctgccgtgggagggtcccccccaaccccgaagcagccccaaccagggtaccacttgaccctggggccctctggtcccaaggtgcccgtgtctccccctctgggaggaatataccttcccaaatggcatggtgtaatactccacgtggctgtcagtgattttcaggggctccttgctgtcatcggccacgatcaccgtcaggtctgggtagtactcacgaacactccggagcatggtcatgagcttgtggggacggaggaaggttttggtggcaatggtcaccaggtctcggagcttcctctctgggcaagaaagggtaggtgtcagagctctgtcttcaagaatcctcactgacgtgcattgctctggaggtttctttacacggcgctgtctcgagtgtttgtggacctcatgccttttgttcacagttgatgttagttggatcagaaaatacattttattattattattttgtctttttgtctttttagggccgcacctgcagcatatggagggtcccaggctaggggtcagctcagagctacagctgccggcctacaccacagccacaccaacacaggatccgagcctcatctacaccacagctcacggcaatgccggatccctaacccactgagcgaggccagggatcaaacctgcatcctcatggatgctagttagattcgtttccgctgagccatggtgggaactccatgagtcagattctcaacccactgagccacaacgcgaactcccaatttgtttaaatggtttctgtcttctagagtgtctccctttttttttggttttttttttgttttttgcttgtttgtttgttcttttcttagtagctgcacctgcagcatatgtaggttcccaggctcccaggctcccagttgaatcagagccgcagctgcaggcctatacctcagccacatcagatctgagccgcatctttgacccacatcacagctggcagctatgcagatactgaacccactaagtgaggccaggggttgaacctgcatcctcacagacaccatgtcaggttcttcacccactgagccacaacgggaactcctctcttctggttctgttggctccagtctgctgtttccttctgtcgagtgggatgcttcaagttctgcctgcctatctgcacttggtttgcaaccggctttcatgctgttactgggaattgagacgcatagagtttcacccatcaagggattcaatatgaccagtcgtgaggcccaggaagaggggaaaagatttaaagacctgagacctgccctgtcacagctgcaatcctacagagagacgtgcctggcctggtttgtttttttttttttgctttttttagggccgcacccacggcatatggaggttcccaggctaggggtcgcattgtagctacagctgctggccacagccacagccacagccacagcgatgccagatccgagccgagtctgcagcctataccacagctcatagcaacgccggatcctcaacccactgagcaaagccaggaatcgaacctgaaacctcatggacactggtagggttcgttaacccctaagccacgacgggaactccttgtggttcttatccatgttcttttcttactgattcataagtcctctgaagtaaaattagacctttgactttcgtgtgtgtggttatttttccccagtttgtcttttgtcatttgactttgcatatggtaggcttccgtcattaaaaacattaaaaattgttatataatttatgtttttagtctttttccttttagtctttttcctaggttttgtgtcttatttagaaaagtcatactttacacagttatttttaaactccaggctgattcctagtacttaaaacaattagatatttgctctacctggactgtaccttggtgtgagctatgagatggattcagcttgttattttcacacagctacacagttatctaacacaatctcttgaacaatccatctttttcccctttaatttgaaaaactaccttgatcacacggtaaaattccaagatgtctatttctgggtttcttttcttttctttttctttttttttttttgtcttttctagggctacacccgcggcacatggaggttcccaggctaggggtcgaattggagctgcagctgccagcctatgccagagccatagcaacatgggatccaagccgcgtctgtgacctacaccacagctcatggcaatgccggatccttaacccactgagcaaggccagggaccgaacccgcaacctcatggttcctagtcggattagttcgttaaccactgcgccatgacaagaatgcctaggtatctaatttgattccactgacatagctcttcgtggtccaataccattctatttttataattattacttattaaaatgtcataaatcattagatttttttcaaaataaattcaaccgtacaataagttaaacgtaatgaagcagtattaaaagcgtattctagcatttttttcctccaaaaaagcttgttggagttctctggtggcctagtggactaaggatccagtgttgtcactgctgtggcttgggtcactgctgtggcacaggttccatccaaggcctggaaacttccactctgcgggcacaaccaaaaaaaaaaaaaaagcttgttaacaggactcctattggagtttttatttcatcgagtctcctcctccatctcagaggggagcccttctgcatctcacccaatagtctccagggacccaccatggagccccagggacaagggtcttacctggtccagggtcatataacttgggcatgacaggatagcggatggtcactggaaacttggccactgaggacttggactccagactcactggagggagaaatcaggtcagggctggtgcacggtatctgggtcactccccacaaggccggggaagcccacgcgatgggggagtgaaggactgaggaccccacagagtctatggcattctggctcctaccctgctgtgtgttccggaagcaacctgctgaccgcctctgaaacgcacatgtctgcccccgtgagactctgtcgggtgaagtgggcttggaatcagaggggtagattaagtttgactctgcatctataatttgaaataccttgggtaagtcacatcacctccacctccacctccaaaaccagggtaacactaccagcccagttcacctcacagtgccttttttgttttttttttttttgaagggctgcaggtgcagcatatggaggttcccaggctaggggtcaaatcagagctgtagctgccggcctacaccacagccacagccacagccacatgggatccgagccacgtctacaacctacaccagtgcctggcaacaccagatacttaactcacgagtgaggccagggattgaacctgcatcgtcatggatcccagtcaggctcgtttctgctgagccacaatgggaagccccttcatagggtcattctgtggtaagacatgtttaaaaatcccaaggtacagagaactctctctctagcttatgctcatggaaaatctgcctcacattcactggggtcctgggaaagcctcctgtgtatctggtcaaagcagaaaaaggtaaatgtcttttttttttttttttttttctttttacggctgcacctgctgcatatggaagttcccggactagggctcaaattggagctgcagctgccggcctacgccacagccacagccacagccaatggaatcccagccacatctgcgaattatgccgcagcgaggcctgggagcaaacctgcatcctcatggattctagttaggttcttaatccactgagccacaagaactccggaaaagggtaatttatttatgtatgtatttatttatttttgtctttttctttttagggctgcacccgtggcatatggaggttcccaggctaggagtccagctggagctatagccaccagactacaccacagccacagcagctcagaatctgagccacttctgcagcctacaccacggctcacgcaatgccggacccttaacgccctgagcaaggccatggatcaaacccgtgtcctcatggatactagttgggttcgttaaccactgagccacaatgggaactcccggaaaagggttttaattcatccagaaagtaagtggggctgccctgagggtggcaggaattggtctcccatgaattctgggagtaagagtcgggtttgggatgggaggggaggaggaagacaaagccactgcccttgggactgacagctcccccacatccctctttcccgtaatgctcaggacaagccactgacacgtggactgtgttctcctctactgcagctgaaaccttcagctttttctttttcttttctttcctttgctttttagggccgcacccgcagcatatggaagttcccaggctaggaatcgaataggagccgcagctgccagcctacaccacagccacagcaacgcaggatgggatctgagccacgtctgcgacctacaccacagctcacggcaacgccggatccccgacccaccggtgaggccagggatcgaaccgccaacctcgtgaatactggtcagattcatttccactgcaccacaaccggaacagggaaccttcagctttgatcactgatgagaacgggagcagaaggggatggtttccaggtgcagagcatgaatgatctgtcctcatgtacagacaagcaggcatttcactgtctttctttcgggtccctccacgggctcaatggcaacacggggatagtaccaggtacactaagtgggaaattagaaacaggagccagggaagcaggcttcctggagaaggaagaccttgagagccgggggcgggggcagtggtggtgtttatggggtccctcagcattttgccatccgaggacggactcacccacatccactctgtggaggtggtactctgtgctcgtgtatgtcacatgctggaggatgaaattcaaaagctcccggctactggtcaaaatgttcagctgcttctggcctctgcccttcaccacattgtctgggacgtcagcaagggtgttcagtgtccccagagaagctgtcagggtgacctaggataaaggaggtagaaagcctaaatgcagagaggcacatacccaggatggccagcagggggcagcatgcataagggtgtgaggagaagaacgcttcatgctcccgaaagctagggtctggcctctgatggagtgtctgccccagccccaaaagcctaggacctaggacctggtgtgttcaagggccatttctgaaacattcttaactcttggcatgcagagttaagtggcatccattcttaaagatttcttctggagttcctgttgtggctcagtgataacgaatccgactaggaaccatgaggttgcaggttcgatccctggccttgctcagtggattaaggacccagtgttgcttcgagctgtggtgtaggttgtagatgcggcttggatccggtgtggctgtggctctggcgtaggctggcagctacagctctgattggacccctagcctgggaaactccatgtgccgctggatgcggccctaaaaagacaaaagacaaaaaaaaagaaagaaagaaagaaagaaaaagaaaactgctgaaaacatttcagtcaacagatcttttcttttcttttctttctttttagggccagacctgaagcacatggaagttcccaggctaggggtccaatcagagctacagcatctttgtctgccccatctttgtctctctgtcaaacgctgagaccagccaccatctcagggaaaagcgcatgggcagtgagccaaggacaggatgctaagtgcaaagtggggctgggaaggggactcttgcctcatagatgggagcatcaggtccttcaaaccggaggcctggaggtcacaggaaaaaggagaaaggaaaaaaaaaaaaaaaaacatttgagaggatgccaagagttccctgatgctctcagctccctggccaattcctacacatccctccagagccccttcaagtgtcacctatccagggtgtttgcagaccgctcgcctccccactagagcttgctagatggtgtccaacggacctctgcaaactccagcaaaccaaagcctctgatgccctcccctagtttgggttttttttttttttttttttgtcttgttgttgttgggttttgggggggggttgggggctttttagggccacaccctctgcataaggaagttcccaggccacgggttgaatcagagctgcagctgctggcctacgtcacaatgacagcaatacagattgtcagctgagtctgcgacctacaccacagctcacagcaacaccggatccctgccccactgagcgaggccagggatacaacccaaaacctcatggtgcctagttggatttgtttccactgcaccaccacaggaacccctaaatggtaaactttatgttacatatattttacacactagaaagagaattatccaaaatggcaaatcattttttaaatgagtacttaaaaacacgagcaactcagagttcctgtcatggcgcagtggaaacgaatccaactaagaaccatgaggttgtgggttcgatccctggcctcactcaatgggtaaaggatccagcattgctgtgcgctgtggtgtaggtcgcagacgcagctcggatctggtgttgctggggctctgctgtaggccagcagctacaactccgatttgacccctagcctgggaacctccaggtgctaaaaagacaaacgacaaaaacaaaaaacaaaaaacagaacaaaacaaaaaaaacccaaaacaccagcaactcatctcaaatgtttttactttaaaatctatctctgttcttatgactaatgcaaattctcactcaaacacatcctccttctgtggcctaaacttatttgggaaattggcaaaataacatttacctcacagggatgtatgctggacgagaggtgtgtgtaaaaaccactcgtggaggagctgtaacggatagaaatattctttccatatgcagtccctggagatgggctgaggctttgcttgctcccttgatgctggcagacaccaaaaagccaataatggcctaagattcctcgaggcacccagatctccgtcctctcctatacgatccaagatgcccagggaggcaacagctcctaagtgccattcccagtggtggaaacagtgagaataacatcaaatgaaaccatgtccagcttcatggattgtgctgggtatccgggaaggattcagcggataactgctcccttctgctcccttctttgcttcagaaggactacgagagctgcctgggtcctgtccgggtggagatgcacctacctgggatggggatggtgtgtagaggcatcacttccaccccgtggaccgggtacccaaaggggaggttgggctgagccagcaggggcggtgggcgagggagcccttctctgcagggaaacaaaaccatcagcagctgccttgatacctgtccctgactagctcttttttgggggggaggggggtgcaaccacacccacggcatagacgttcccaggccagggatctcacccaccccacggcagcgacctgagccaatgcagtgaccatgccagatcctccttaacgtgctgagccacaagggaacttccactgctcccactggtttgttcttttttttttctttcgtttttggccttcccaggccagggatcagacctgagctgtggctgcgacctaagctgcagctgcagcaaaagatctttaacccactgtgctaggccaggggttgaacctgcatccccgtgctccccagacacagctgattccactgtaccacagcaggagctcctcactgtcgccactggctagttctttttctttttttctttctttttttttgcttttttagagccacttcccgcggcatatggaggttcccaggctaggggtccaatcagagctgtagctgccggcctacgccacagccacagcaacgcgggatttgagccgcgtctgcgacccacaccacggctcacagcaatgctggatcctgaacccactgagcaaggccagggatcgaacccacatcctcatggatactagtcaggtttgttaaccactgagccacgacaggaactgctggctagctcttaaaggggtatctgtgcccagagctttgggctgcaaagggggagaaatccaaagtaaatcgtcggattgtcatgcattctctcctcttctttattcctgctcctccctccagcctcgaattccacaaagaaactgaggcagattacaacaacacacattaaaaataaaaatcacggagttccttttgtggctcagccggttaagaatccaatgcagcattcttgaagttgcgggttcaatccctggcctcgctcagagggttaaggatccagcgttgccctgagctgtggtgtaggtcgcagacgcggctcggatcccacatggctgtggctgtggctgtggggtaggctggcttctgtagctccgattggacccctagcctgggaacctccatgtgcctcgggtgtggccctaaaaagtaaataaataaataaaatgaaacataacataaagagaacaaaggtaacacctgctcacactcaccacgttcgaattattttaatacattttcaattgctggttttcaatgtgagccattttaaataaatctttacatgcaatattaaaaaatattaaaatattatctctactcttgaggttatttgcatcaatctccctgtggatggagatattatataaccggcatgcaatgatatctcgtgggagacttgaaatcagccacagtgtgatttcttgtagggttgagtttttttttaatttttgaactttttactaaagcagggttgatttacaatgttgtgtacagtgtgattattaaaccgtggaaattggcaaacactacaagccactaccaaaagcccatggttaaatattaccaccactattcatatttctccctcaacgtataaacacatctacccacacttatacacacaactatcccctcctcttttaaaaacacaaatgtggagttcccattgtggcagagtggaaatgaatctgactaggatccatgaggatgcagattcgatccctggcctcactcagtggggtaaggatccagcgttaccgtgagctgtggcgtaggtcgcagacgcggctcagatctggcattgctgtggctctggcgtaggcaagagtctacagctccaatcagactcctagcctgggaacctccatgtgccatgggaagtggccctagaaaaggcaaaataccaaaaaaaaaaaaaaaaaaaaaaaaaaaagagggcattccctcccccctccttggagccacaccctcgggaatgagtagagagcttccgctccatctcagggcgcaagagccctcagcatctgcaatacctcctctgaaagtgttcgagctcagcctgtctcctcaggttcactgcggggaggtcttgcgggtcgtaggcatcctccaagttatagctttcctgatgcccgaaggcgtcacattggcactggtttttcgggaacagcctaaaataagacaaggtcaaagatcacagattgggaaagtgggctggtaggtgagggggagccgcaagctcggtccggtgtattttttttttttttttaactttttattttctctttttttgtctttttagggccgcaaggttccgaggctggggtctcatcggagccgtagccaccggcctacgccagagccacagcaacgcaggatccgagccgcatctgcgacctacaccacagctcatagcaatgcttgatccttaacccactgggcaaggtcagggatcgaaccctcaacctcatggttcctattcggattcatctccgcggagccatgatgggaactcccaatccagtgtgtttttccccctaggctttcccatacctagcgccagggttgggttgagaccctggaatcacagcagcggccgctcccaaagacacagggaaggaagggaagagaggaaggaaggagggcgagaaggccccctctctggaatcaaagtcctttatttattattattattattatttgctttgtagggctgcacccgcagcatatgcaggttcccaggctaggggtccaatcggagctacagctgccaacctacaccacagccacagcaagatcagatccaagcggcgtctgggacctacaccacagttcacggcaaccccgatccttaacccatggagcgaggccagggatcaaacccacaacctcatgcttcctagccagattcgtttctgcagcgacatgacaggaactccccaaactcctttaaacttgagagtcacaggaatctcagaggcattgcagccccacccaccagatgaaaaggccagagggccagaaaggccacatctttcctataattttgtttagttttgggggttttaatgtgtttttgttttttagggccacatctgcagcatatggaagttctcaggctagcggtggaatcggagctacagctgccggcctacaccacagccacagaaacatgggatctgagctgcgtcttcaatctacaccacagctcaccgcaaccctggatccccgactcactgagcgaagccaaggatcaaatctgcgcatcctcatggatcctagttgggtttgtcaccactgagccacaacgggaactcctcctacagttttggttaaataggccctccaaagtcctaaagaactttgctgggtgctatagaggctatgcccagcagaccaagcccctttctagtcccgccgtttgcagtcaaatgctctacccctgagccatactcccaccaggtcccgcagtcaggattcacattcccaatcagcacaggtgcagaaaggtagggaactggctgtaaagtgggcataagaggacacagtaggagttcccgtcgtggcgcagtggttaaccaatccgactaggaaccatgaggttgagggttcgatccctggccttgctcagtgggttaaggagccagtgttgctgcgagctgtggtgtaggttgcagatgtggctcggatcctgcgttgctgtggctctggcgtaggccggtggctacagctccgatgggacccctagcctgggaacctccatatgctgcgagaagggcccaagaaatagcaaaaagacaaaaaaaaaaaaaaaaaaagaaaaaagggcacagtaaagccacaggaggagccagggaagtgtcagtgcaaagtggtattcttgccatctcacccgttttcaccgtagaaatcgggtttctcaggtagaagcttcagcgtctgcgcatccagggtgggggacgggatgggtgagttgaggagactgaagtctgtatcgaggaacacgctttggaacataaagagtccaacgctcaggaccaaaagcaccatcaatatcttgaggatcgacagacatctagggctgttgggacacaagagagcaaacgctgttaaaatcttttctgagtatgttaaaaaagatttcattgtgcgacatagatgggaatagcaacttgagcaaaaatgcaagtcaaacctgttttgtacactacgtatcaaaattgatttcttcccaaggcaaaagagaaagaaaagcaaaaataaacctaagcaaactgacaagcttttgcacagcaaaggaaaccataaaataacccaaaaagatcctgctgggatccactgggaacgatgtctggtcacttgcgatggagcatgatcatgtgagaaaaaagaatgtatacatgtgtgtgtgactgggtcaccttgctgtgcagtagaaaattgacagaacactgcaaaccagctataatgggaatgataaaaatcatttaaaaaactgatttcagataaatagaaaagtaaagaatcaaatctgcagagagttccctggtggctcattgggttaaggatctggtgtggtcactgctgtggctctggtcaccaccgcggcatgacctccatccctagcccaggaacttctgcatacgtgggcatggccaaaaaactatactcagtggaaaatgtgaagtttttcaaatacgcacttctgatcacaagacctaaaattaataaatgaagcaataaaataagagatttgaaaatggacaacaaaatgaacctacgaaaagcagaaacaagattttagagatagccaaatagaaagtggtgaatttaaaaaaaaaaaaactaaaatggaatcatcgttaaatctaagcacagagtagacaactggttttttcttttatttttttaaaattttatggccacagccatggcctgtggaagttcccaggccaaggactgaatccaatccatagcttcaacctacacctttaaccaccgcactgggcccagggatcaaacctgcacctctccagtgacctgagccactgcagtcggattcttaacccactgtgccagggtgggaattccagacaactttataacctccttgctctaagactttcctcctgacccagaagtgacacctacaaacgagtctggttatatcacatgacgctcccctggtcctggctgagtaagcggatgttcacctcatccgaatggggctaatcagccagaatttccttcccagaaatggggaaccagagatattgttcggctaatcctaatcccctgaactgagaatagaggggaggaaagaagagagagaagacagaaggtgagagaaacaaaagaagcctagaaggacttcccattgtggctcagtgggttaagaccatgaccagtgtccctaaggatgcaggttcaatccccacccttgctctggcattgccacaaactggtggcagatgcggcttggatctggcgttgctgtgcctggggcataggctggcatctgtggatccaattcgacccctagcctgggaacttccatgtgacacaggtgcggccctaaaaaaaaatcgtttttaatttaaaattttgggggcagtgtctttaaggcattagtctgctatggctccctttgcctgacaaagcaataaagctatctttttctccttcacctgctcctccccccaaaaaagagttcccattgtgccgcagcagaaacgaatacaactagtaaccatgaggtttcacgttcgatccctggccttgctgggtgggttatggatccagcattgccatgagctgtggtgtaggttgcagatgtggctcggatcctgcattgctgtggctgtggtgtaggcctagccttggaacctccgtataccatgggtatggcactaaaagccaaaaaaaaaaaaaaaaaaaaaaaaaaaaaatttaatttaatttttaaaattaaaaaatttttaatttagtttttttaacttaaaaaaatttttttaaatagagaagcctagatcctgaatacctagatgaaagggatgactttctacaaaaacgcaaatgaataatgtattggggaaataaaataaacaaataaacaaataaataaaagaattcccactgaagcaccgcccccccaaaaaaaaacccacaaaagacttaaacagacctgtaaaaatttaaaaaaaaaaatcaaggagttcctttcatgcctcaggggttaatgaattcaactatgaaccatgaggtttcgggttcaatccctggccttgctcagtgggttagggatccagcgttgccgtgagctgtggctctggcgtaggctgacagctgtagctccaattagacccctagcctgggaacatccatatgccactggttcgaccctacaaaagcccaaaaaaaaaaaaaaaaaaaaaaaatccaggaatttatcaaaggtctatgtacttttcaaagtcccaaatccacacttcacaagtaactccagactggtttgtaagaaaccagctttgcagtgatgcaaatataggtactgaccaataacgatgtaaatacgccaaacaaatattaaccagtgggacacaacagtatcttaaatgaatgagtcaccgttaacgaatgctgttcttggagttcccgtcatggctcagcagatacgaatctgactagtatccatgaggacacaggctccatccctggccttgctcagtgggtcagggctctggaattgctgtggctgtggtgtaggtcacagacgtggctcagatcccgcattgctgtggctgtggtgtaggccggcagctgtagctccgattccacccctagcctgggaacctccatgtgccgcaggtgcggccctaaaaagacaaaaacaaaagcatgttccttctaggagagcaaggataactcagtgccactgtggggcaaaaccacaccgacgccatgctgtcagctcatcttaggcccacagtctcatctgctccccctccttattaaaaaaaaaaaaaaaaaaaaagaatgatcacatcctaagttcctaacacaattttcagactatcagatagaaacaaatcactgacaacctgggtggggggcagcatttgggggaagtgagtgtggtcttggcctttttgagggttgggtttgtttccttttgctattaggtactaaaacttaaaattgcatcacttagtgaaaacagaacaaaaatagggtcggactttctctgtggctcaacaggttaaagacccagtgttgtcactgcagtggccctggtcgttgctgtgccatgggttccattcctggcctgagaacttctgtatgcctcgggcgtggccaaaaaaaacccaaacaaaaacaaaaacagaaacatgagttcctgtcgtggcgcagtggttaacgaatccaactaggaaccatgaggttgtaggttcgatccctagcctcgctcagtgagttaagggtctagcgttgccatgagctgtggtgtaggtcacagacacagctcagatctggccttgctgtggctctgccgtaggccagtggccacagctctgtttcaacacctaacctgggaacctccatgtgcggtgcattcagccttaaagagaaaagaaaaaaacaaacaaacaaacaaaaaaaaacaatagtgaggaaaagtggcatcattttacctttttgcctatttaatgtttagcttaatagataaaatgaaccatctgttaggacaggttgtttcgctgaagaatatgaagaaaatacaaccccacacaggtatgtcaccagaaaagggagaaacactttaattgctttttcaatattgtagatatttatctttgatactacaccaaaaatcaagaagttagtagcaggttattgttttgttttgttttgcctgtggcatgcattagctcgatgtgggattttttttttttttttttggctttttttttggccttttgccatttctagggctgctcccagggcatatggaggttcctaggctaggggtccaattggagctgtagccaccagcctatgccagagccacaggaaacggggggagttgagccaggtctgctcaccttacgccacagctcacagtaatgctggatccttaatccatctgacccaggccagggatcgaaccctcaacctcatggctcctagtcaaattcattaacctctgagccacgacgggaactcctcaatgtgggatttcagttcccagtccagagactgaacctaggccacagaggaaaaaagcgtgaacctgaacccttagtagctagggaacttccaagaagtggtactttcttaaaaagttagttaagtgtggactctgaaaccatatcagtgaaaaaaaaatttttttgctttttttttttaggaccccacctggtgcatatggaagttcccaggctaggggtggaatgagagctacagctgctggcctacaccacagccatagcaacgccggatcctaaacccaccaagcaagggaacaaatagagggagtttccactgcgcacaatgggatcggtggcatcactgcagcgccagggacacaggtttgatccctgacagcataggttgcaactgtggctcagatctgatccctggcccaggaactccatatgccactggcacggcccctccaccctgccaaaaagagtttggaggcgttccctggtggttcagtggttatggatctacactctcaccactgtggcccaggttcaatccctggtctgggaactgagatcccacatcaagccgctgcacaccttgcccaaaaaacagggttttttaacctttttttttttaaactgttattccccaatgcgatttttttcccctactgtacagtatggtgacccagttacacatacatgtacacattctgttttctcacattatcatgctccatcataagtgactagacagagtttctttccttttttctttttttctttattttttaattacttccccaatacaatttgttaaaagggttttttaatcctgataataaacacataaaatttagtaccttggagttcccgttgaggctcagcagaaacaaacctgactggtatccatgaggatgcaggttcaatccctggcctcactcagtgggttaacgatcccgcatttgccatgagctgcggtgtaggtcgcagatgcagctcaaatctggcattgctgtggctgtggtgtaggctggcagctatagctccgatttgacccctagcctgggaacctccatatgccataggtgtggccctcaataaaacaaagaaagaaagaaagaaagaaagaaggaaggaaggaaggaaggaaaggaaggaagaagggaaggaaaggaaggaaaggaagaaagaaaaaatttatcaccttaactacttctaagtgtacatatactttcataatgtagattgttcatgtcgttttagaacggatctccagaacttttttctgcttttttctttgcttatatttttgcatgcaactatttttatccattttttctgattatgaaatttttatcttttacccattgaagaaaaaaaaagttcctctttacaaaaacaaaacaaaacaaaacaaatatatgtaggagaaatgatagaattagaaaaatcaccactttgctaccaacaatgtaataaatgattctggccaggattgtccatcttttttttttttttttcctcgtttttttgcaatttcttgggccactcctgcggcatatggaggttccaaggccaggggtccaatccgagctgtagccgccagcctatgccagagccacagcaacgagggatccaagccgcgtctgcaacctacaccacagctcatggcaacgccggatcgttaacccactgagcaaggccagggatcgaacctacaacctcatggttcctagttggattcgttaaccactgagccacaatgggaactccaggattgtccatctgttctaaaacatttgccaggtgcaggattttgttttgttttgttctgctttttgtgtttttcttcttctttttcttttttctttttctttttttttttttcttttttgtctttttagtgctgcacccacagcatatggaagttcccaggctaggggtctaaccacagctgcagctgccagcctacgccacaacagcaacagcaacgttggatccaagctgtgcctccaacctacaccccagctcacggcaatgccagatccttaacccgctgagcgaggccagggatcaagcctgcatcatcatggatactagtcgggttcattagccactgagccacgacaggaactcctggaggcaggatattgaatggtgccattccggagaacacttactacttacaaagagataaaaacacatctttgcaatgaaaggatcatgcatcactaccttaaccacatggtcaaataaacatccctaatagtgaggcagcctgaccaactgtcctccggatatgatgataggaagcacacagatcatttaaaggagtattactgccaaaatatttaaccgaaatgtaatcaaggatcagagacctcactgccaatttataggaaaaaacaggggataaaaatttagtaacaccatcaagaacaatagacaaatcagggacatcagaatgttttctgcaagacaacaggcctgaactcttgacaaaggaaaaaaagtgggagttcccgctatggcacagtgggttaggaatcggactacagcagctcggggcattgtggaggtgcgggtttgatccctggcccgctatagtgggttaaaggatctggcgctgtcaaagctgcggccattaaaaaaaaaaaaaaaaagaaaagaaaaaagaaaaagcaattgaaaaaaataaaaagaatgagagtgaatgagtaacatttctagtaaagggttgcctgtatcttgtgcagaacatacagaatacatctttcaatgattttagtcaatttttttgcattttaagaaatttctttttttttaattgtggtatagttaatttacaatgttgtgtgaatttcaagtacacagcaatgtgattcaattacatatatacatatatacacatacatatcctttgcagattcttttctattataggttgttacaacattttttttttctttttaaggctgcatgtgtggcatatggaagtttccagactaggggtcgaactggagctatagctgcccgcctacaccacggccactgccacagcaacacggtttccgagccatgtctgcaacctacaccacagctcacagcacgctggatccttgacccactgggcgaggccagggatccaacctacaccctcatggatactagtcagattcctttctgctgcaccacacaggaactccctattataagatattgagaatagctgtcctgtggcacagtgggtaaaggatctggtgttgtcactgtagtggctcaggttgctgctgttgcacaagtatgatccctggcccaggaacgcttgggatggcattaataggaattgtttggtaggagatttttaataaaatgttcaaccgcccaatttttaatagataactacaaatgttctccactgttaaaactgcactttatgtacttaagtggggatgttaaaattatatgggtccgcccgctattatagttgaaccacatttgagacacattcaaaaaagggtaaaaatcgggagttcccactgcagctgcgggttcaatccctggcctcactcagtgggttaaggttccggcattgccatgagcggtggtgtaggtcgcagtcgcggctcaaatctcgtgttgctgtggctgtggcataggctggcagctacagctctgattggacccctagcctgggaacctccatatgccgcaggtgtggccctagaaaagacacacacacaaaaaaaaggttatgttgaagttcccgttgtggctcagcagtaacaaaccggactagtatccgtgaggacacgggtttgatccctggccttgctcagtgggttaaggacccagtgttgccacaagctgtggttgcagtgcaggtcacagacaaagcttagatctgacattgctgtggctgtgacacaggccagcagctacagctcaaattcgacccctagcctaggaacatccacccacagggggcggccctaaaaaaaaaaatatatatatatatatgtgtgtgtatatatatatatatatatattttatatataaaacattttatatatatatataaaatatatatatataaaaatatatatatatataacattttatatatatatataaaatgttaacattgagtaggtttaaggttattattttaataactttataaataaaaattttagattttctcagctttaatttttaattaggtgtggagttcccactgtggagcaacaggatcagcagcatctctgaagcgcagggatgcaggtttgatctccagtcctgcacagtgggtcaaagatccagcattgccacaactggggcataagtctcaactggggctcagctctgatcactggcccaggaactccatatgcatcggggcagccaaaaaagaagaaaaaaaaagtgtctaatatggtaataggaatagatacaacccatgtaaacaaaagttttttggggtcttcaataatttcgaagagtgtaaggggtcctgagaccaaaaagatcaagaacggctggtctacgttctaagcaactgctgtggttcttgttaagttttaatactgaagatgagtttttacaaggacaaacaatataatacagggcatgtagccaatatttcgtaataactataaatggaatatagcctttaaaaaggccaatcattctgtggcaccctgaaatttatatgatacatgaactgtacctcaataaaaaaatttaataagataataataatataggtgagcttcaattagcacattctattacttatctttaataaaaattatattctgtgtgcaaggtaatctgacaaactcaccagtacaactggtttccaacatagacctggctcagctgcagaggttcctttcaagagtaaacttgcagggctttccccgctgtggcacagcagaaatgaatcagactagcatccatgaggattcagggcacagaaacagctcagatttagtgttgctgtggctgtggccatggtgtaggccagcagctgcagctccaattcgacccctagcctgggaacttccatatgctgatgtaggagaaaatgtcccaataaaatgtagaaaggagagaccccggccatgacgactaagcaaagtctagccaactgccccaaccagtcctcccccatgcatctgcttctgtaaatttgtttccgcatctactaccttgcctgacgtcactccagtccaactagccaagcttggacctggaagacgtagcccataaaagccttgtgaaacccttcttccgggctcagactctggagagtgatctcgtctgagcccgccggcgtaataaacctgagttctccaactctccaagtgctcgcttggtttctcgccgggtaaaagagctgctccactatggccacagagctactggagctggtacgctacagccacggggctgtcgccagagctgatacgctgcagcgcagggctgctgggtatctgctgtaacatttctggaggccccagcgagattccaacctttctggccccttgagccactggaacagaggtaaggccgcccgggagccggggagcctcaaaccgaacgaggcggcgcaccacccgacggtattctgggtcctccttcgtcagcggcattcctgattcccgggtgaccaaaccctgaccagactcagtggagagatggaccaactcaccagaaaggtatccggacaaggtaaggcagcggggccaaccccagtcaggtcctgccccagtgggcagaagaggggactgatcaccccctgagggagactctcccggtcagaagctgtgcctgactggagcagcagtcctagtgctccagattggaagcagaggaacctcttgcttgggtggagcaactgtcaggtgtagccaattgaaagttgtgcttgatcgagctactagttagggactcccagggagtgggaggcattgtgataacctctgagtgtgtgtgagagtgaatgagcggcctgattcgcttgtgcttcaggttcgagtttgtggctccacggtcttagtggctatggagtctgagtgggtcctaacctgcagttccgtggtgacctcatagggcttatggctgcagcagactctgagggttctgttccctccctgcaagtccaatccaagttcggggattatacgaaccagccaattgctaagaggcacctaaactcccgagaggggggcagtcaggcggacatctgaatggccaccttctgagaaggaggcaccctcccttgttttgtctgcgacactggcacagggcgtccacatggggtgggacctaacccagaagcccacgagccagagacccctgtgcttccgccattttgggccataaattcctccaaggagatgacctaatttgatcttgcccctgggcctccaggaactcccggcccagattctaaaccagccatgggactgcctattttgtcagttcatggaggcccaggatctgagtcagggagacaagcctgtcatccctggctcagttcagggtatagggaggattgggtacaaggtcccctgtcctttgcccaaaacattagaacttgtctgagagtgccttcctgagaccgggggtccagatggattggagatacttgcaataaagcaggtgctcttcccagtcatagagcaagctgagtgggatctgtcttgctttcaagagtggtggaggcaaagctactggggataccacccacgaggccagaaaaggtctcataatatcaggccatagaaaagatccacataaagacaccatgggttcacccaagtctaaacctgtggttgtagactgtgtgatcaaagatttcaaaaagggattttctgaagattatggtataaaactaacctgatctttcatcatttcctttgccattacctcaaatagagctgtgggggcaaaggaaacagacctctagatgttaagaccatcctgagttgttaccaggcctgtgggggaaaaggagttcatagctagtattcatccaacttaggccaagtgtttagcctcagagcctcggcatagtcagttttgctttttgctgtttactttcatcctggttggagtaattgatggctggttcatccaatttacctgttaactgtggtttagaaactttcctaatgttaatacagggcatgtcagagtgagcatcttaggatttgaaaactcagggcagggcctgtatgcctgggttttcttcacctctgtccagagacaggcactgggcagggatgacgggaagagaggctacgctggtaaggagtggttaattccagtcagcctgaggtcggatgggacatttgaccactagtgtctagctgctccatataagagaggggacaccctcacatagccaagaaaggacaataggcgctggatgctgttttttgtctttttcggatgggagccacatcctcaagcctgctgcatgactcaatagcaacccctctgacatgtgccttgaagaactggaaaaagtttgaccctgagattctgaaaaagaaacatttaattttctttcgaacaaaagcctggccgttatataatctgtcagatggagagtgacagccatctgaaggctcactagcttataataccattctccaattagccagaagttagtcagccttctccaatactgctcaaggctccttctccccgcaagccagtgccaaagttatatctctctctactccctttacaagaagtagcaaacagagaatggaggccaaatacaggtctatatacctatttcacttcaggacttagggcaaataaaaacagatttgggaaaatttgctgatgacccagatatattgaggttttcagggtctcatgcagtcctttgagttagccttcaaggacgtcatgttattacggaaacagacattgactataagtggaaaattacataaagtctccaaaactgctcaaagctggggaagatgaatggaatgatgctaaaaatgccagaggcagattagaagaggaatgatcaagattccccacagggtgtcaggcagttcctatgagcgatcccaattggtctgctgatgagggagataacaacaattggcatagaaatcattttattacttgtatagttaagggattaaaagcccgttaaaactatcggaggtttactaggggaacaagagtccatcagctttcttaaaaaggctcagaaaggcattgagaaaacataaaacagggaacccagaaacaatggagggccaaataattatttatttatttatttattgtctttttgctatttctttggccgctcccgtggcatatggaggttcccaggctaggggtctaatcagagctgtggccaccagcctacaccagagccacagcaatgcaggatccgagccgagtctgcaatctacaccacagctcacggcaatgccggatcgttaacccactgagcaagggcagggatcgaaccctcaacctcatggttcctagtcggattcgttaaccactgcgccatgacgggaactcccgaataattcttaaggataaattcatagctcaattggtgccagatatatggagaaagctccaaaaattggcttttggccctgatcaggacctggagcacctcctcagagtagcaactcaagtatgttataatctgggccaggaagaataaaaggagaatgagaggagagacagagaaaaggctgaggctctagttatggcactacagggagtcaacctggaagttgccaaggtgagaggactagggcagagacctatgcctgcagcctgtttcctctgtggaaaagagggaccctttaaatgggaatgccccaagcctcagaccacagcacctaggccatgccccatatgttggggagatcactggaagagggactgcccctgaagatgaaggtctctggggttgacccctcaggcccaggatcaaggctgacaggacatttccataatggctcctgtccttctcaccactcaggagtcctgggtgactctaaatgtaggaagacagcctattgacttcctcctgaatacgggagccacttttcagtcctcctctccaatcctgggcccctccctcatgaatctgccacatttatatttccggcaagccggttacaaaatttcttacacagcctttgagttgtggctgggaatccattttcttctctcatgcctttctgattgttccagagagtccaactcctcttttagaaagagatattttgtaagaggttaaagcctcaattcacatggcaatggagcctaatcaaggtttatgcctgccttggatggaagtatatactgacccagaagtctgggccataggaggaaacataggaagagaaaagaatactcaactggtggaaataggtcttaaagactggaatttatttctttgccaaaagcagtatcctctgagacccaaggcatgacagggacttgtatcaattataggaagcgtaagagaacagattattaattgactgtatcagcccttgtaacactcctatattgggagtgcaaaaacttaacagggattggttcctagtacaagacctccatctaataaatgagacactggtctcattacatccagtggtgcccaatctctacactcttctttcacaaattccagaaacagcagcatgggttactgtatcatatttaaaagatgcctttattctgcatttccttgactaaggctttgcatatataaattctcaaaatatggaaggtaactaactgaccagaattaattttaggttcaagtcaactgggaaatattcagtattaaattaatatcttaaattagaattgaagtttgctgatctaattaatacacacatgtcgttacagctgtcaacattaggtataatatcttatcgtacctaggtttaacagaagtcaaatgagacactgagacatcagttactaaacagaaactaaaggtatttagaataattaatcaatatgatcagtttcaccctgaatggtctccataagaaaaacatgtgtttttagaaattataaaggacagtctgtggttgctttagaaacgtagaatctgtgtgctttcaatatagaaggaatgagggatggaactgcattttatgaaggcaaaagaaagtctgtcttcagctgattgctctggttggaaaataagggacagactaatatggatacagaaagtgatacaaggtgtgtgggaagtggacactgagaattttgtgcatggtggggactgtctatatttgagtaagttaactttaaaagtaatgtggtgccataaatcatactgctcacaaggacataaggtagctttcaattacatgttgaccaaggcatacaagtgtttcataaccagccagagaaatcagaaaaatcatacaagttacctgtgctattataaaatctaaatgttgtattcttgatggttcacagaatgtgtctaattccctgctagatcttcaacagtagattcatgagcggtcctatccagctccagcttttggagctgccctgtggaaccagccgacctcctcctcctggtgaaaatatttcttcaccatatctttttattcagaccctgtataattaactgtatttcttgcttcattacatcctgattaaaagccatcagccttaaaatgttgatagaaggggtacccaaagcaatgtatcaaagcccacttgaccgtcccatgagtggagacctaactgctttccctaatgacgccccttttcagcaggaagaagtcagagcggtcatcgccccctttccccacagttagagtctctaactcactggtgggattgaggcagaatattcactcaggtagtcagtgtaggaacatgggcttcgatacattctttgatgtggctattggttaacatttgtaaagtaagggttgcacagcaaccccaactgctataaaggttacaggtattaccccatggatccatcacaccggaataaagaaggctgctcccgccattgacacagacacctgggaagctgtccggcaccctgagaacccccctcaggatcaagttccagagacatatggcactggaggatggcaggccctgctctggtcacacccagaagctggccagtctatgcacggcagaaacttgaggagtctacagccctgccccagccacatactggagttggttggtttgtacaagtggaggccagaggatctctatgcaaacttgaattgaactcatgctctggtggggaatattggtaattgaaattgccatagccctcatatttggagtggggctatatgcagtatccccttcagaatggggacagggagcccagctactcatctgtgtgatgtatctcctgactgtcagtatactagaatccctgttcataatgggtcagtgaaaaggatcaaaggaatcatagttctgttaacactcaccctgctgctcactccaggggcaacagactgggacaatgatctatgggatgggacgggattaacagatgcttaccagtgcctccctgctaattggacagggacctgcactctagcctttgtcactcttcaaatagatattgtccctgggaatcagtctcttatggtgcccatagaggcacatggcagaacaagacagcaatgcaagttatccccttatttagttggtttgggaattccagcagggataggagcaggagtgggaggaatagaatcctccactgcttattatcatcaattatctaaagaattcacggatgatgtggaacaagtagccccttccctagtagccttacaggattaggtagactctctggcagaagtggcccttcaagacaggagagcactggacttattcactgctgaaaaaggggaactttgcctgatgaagaatgctgtctttatgccagcagatctggaatagtcagaaacatggcccaacaaataaaagaacgcatagcaaagagaagggaagacttagataactcctggttaaattggagcaactactggagttgggtggcatggctcacgctttggttgggcccctcctcatgctcttcatggccctcacatttggcccctgtatcctgaactgtcttgtcaagtttgtctcctcaggcctagaatctataaagctacaaacggtggtgatgtcccggccacacttatatcagcctctgggccaagaagaccagaaaggttgatgcttgctccaagaatgtgaaaaagcatcaagagggggggatgtaggagaaaatgtcccaataaaatgtggaaaggagagaccccggccatgacgactaagcaaagtctagccaactgccccaaccagtcctcccccatgcatctgcttctgtaaatttgtttccgcatctactaccttgcctgacgtcactccagtccaactacccaagcttggacctggaagacgtagcccataaaagccttgtgaaacccttcttccaggctcagactctggagagtgatctcatctgagcccgccggcgtaataaacctgagttctccaactctccaagtgcttgcttggtttctcgccgggtaaaagagctgctccactatggccacagagctactggagctggtacgctacagccacggggctgtcgccagagctgatacgctgcagcgcagggctgctgggtatctgctgtaacactgagggtgcagcccgaaatggtaaaaaaaaaaaagaaaagaaaaaaaaaatagtaaacttgcaaccacagtaagtatataacggagttcctgtcatggctcagcaggaaagaatccaagtaggaaccatgaggttgggggttcgatccctggcctcgctcagtgggttaagggtccagtgttgccgtgaactgtggtgtaggtcgcagacatggcttggatctgacattactgtggctgtggtgtaggtcagaggctacagtcccaattagacccctagcctgggaacctccatatgtcgcgggagcggccctaaaaggacaaaaagaccaaagggaaaaaaaaaagaatgtatatatatgtatgagtgagtcacttggctgtacagcataaattggcacaacactgtaaatcaactatactttaacttttcaaaaagattaaaaaagaagcattggcgttatcctcaagtacagctggattcccatctgctccttataatgctgcccttgggcaacctccattctccatgttcacagctctgaagtggacataactcttccaagagtgttgctgggcgcattagaggcacaatctagaacagggcctgtacgtaacagataagtgctccacagtggatgaaatgaaatgaattcaccaacaggaagtaacgatcatttcctgggttggtagggtgtgttgtagtgaaacatcctttctcagagggacaaagatcagaaatgcacatttcaaaatcagacactctttaatttaaaaaaaaaaaaagaaagaaagaaaagaaaacgaaaaaggcaaataaacatttaaaagagtaagtttcttctgaggaagaaacctgtttcccaaggtcacccaagccagcagccttaaaatcttagagacataaacacagcaacatggacttgccagaatgttcggttggcaccagtttggatcctggtatcaagactcctggtcattctcctcattcactaaggaatgtgggatgagataattttggggaagtgctggaaggaaagccttagaagggactttagctggtaacgcaagagctacctccctttgctgagttctgccatagcctcagtacaaacgtgtttcttggtttccttatttgtttcggcagcgccagggcatgaggaagttccccgggtggccaaggatcaaacccttgccacaggaggaaaaacgctggatccttaacctgctgcaccatcagagaactcgtatacttcattttaatcctcataaaacatcatctaaccaacacggttccccccctccccttttttaagccatttagggccgcaggtgcctgtgtatggaggttcccaggctggaggtctaattgaagctgtagccatcggcctacaccagagccacagcaacgcgggatccgagccacgtctgcgacctacaccacagctcacggtgacaccggatccttcacccactgagcaaggccagggatggaacttgcaacctcatagttcgtagtcggattcgttacccactgagccacgacgggaactcccacaagacgtatttctgatccttctttctgtttataaaaattaaatgagctcaccaagtccgcacttcctccgttaattattatgctactcagaagttttttttagcaccccaaaccacaaaacggacgctcgctccaccgcgaggctgtcttccggagcagaaaactgaccttttaaaatttttttttcttttggtctttttggggccgtaccctagggcatatgtaagttcccaggctaggaggtctaaccagaactgcagccgccggccttacgctgcaactagatgctacgccaggtccgagtgcgtctgcgacctacaccacagctcacagcaacatacccactgagcgaggcaagggatcgaacccgcgtcctcgtggatacggggggcggggaggggcgtaaaccgttgagctagaacaggaactcctagaaaaccgacttcttcaaaaactctgcctctaaaacccccaagctgttatttaatgcagcgtaaaggacgcagcctccgcttccccacagcctggggccccacagcctggggcccgcacatcccccgagacttacatccccagccctggtcataacctccgagttccgggccgccccccgtgctctgcgccacgagaggcaacctccacgtcgaatgttcccctggaaaaccagtgttccttggggcgcagggcgggggaacgagcaggaactctcaacagcgtcccgaggcgcagtctccttctcgctgtctcaccgacgtacggagccggtcggacttattttggagacccgccgccccccctactcggctccggggtcccgggacctggccgctcccgggtggcgccactggctggccaagtttgacttcccatttgtctctgctcgagggacacgcacctgtacgaagtcatccttaatcccgccgcctcgggacattctgggctggtggtgccactccgcggattggacagccctagcaccaaccccggcaaattcttcctggtaaaccgcgagagcttgggtcggacccgcccacgtcaccaccaacccccgc

SEQ ID NO: 24 - DNA, 2012 bp, Sus scrofa
tccgcggagtggcaccaccagcccagaatgttccgaggcggcgggattaaggatgacttcgtacagccctagatgtctgtcgatcctcaagatattgatggtgcttttggtcctgagcgttggactctttatgttccaaagcgtgttcctcgatacagacttcagtctcctcaactcacccatcccgtcccccaccctggatgcgcagacgctgaagcttctacctgagaaacccgatttctacggtgaaaacgggctgttcccgaaaaaccagtgccaatgtgacgccttcgggcatcaggaaagctataacttggaggatgcctacgacccgcaagacctccccgcagtgaacctgaggagacaggctgagctcgaacactttcagaggagagaagggctccctcgcccaccgcccctgctggctcagcccaacctcccctttgggtacccggtccacggggtggaagtgatgcctctacacaccatccccatcccaggcctccggtttgaaggacctgatgctcccatctatgaggtcaccctgacagcttctctggggacactgaacacccttgctgacgtcccagacaatgtggtgaagggcagaggccagaagcagctgaacattttgaccagtagccgggagcttttgaatttcatcctccagcatgtgacatacacgagcacagagtaccacctccacagagtggatgtggtgagtctggagtccaagtcctcagtggccaagtttccagtgaccatccgctatcctgtcatgcccaagttatatgaccctggaccagagaggaagctccgagacctggtgaccattgccaccaaaaccttcctccgtccccacaagctcatgaccatgctccggagtgttcgtgagtactacccagacctgacggtgatcgtggccgatgacagcaaggagcccctgaaaatcactgacagccacgtggagtattacaccatgccatttgggaagggctggtttgctggcaggaacctggccatatctcaggtcaccaccaaatatgtgctctgggtggacgatgacttcatcttcaacagcaagaccaggatcgaggcgctggtggacgtcctagagaaaacggaactggacgtggtaggtggcagcgtgattgaaaacacattccagttcaagctgttgctggagcaggggaagaatggcgactgtctccaccagcagccaggatttttccggcccgtggatggcttccccgactgcgtggtgaccagtggtgttgtcaacttcttcctggctcacacagagcgactccaaagaattggcttcgacccccggctgcagcgagtggctcactcagagttctttattgatgggctcgggagcctgctcgtggggtcctgcccacacgtgatcataggtcaccagccccatttaccagtgatggacccagagctggccaccctggaggggaactacaccagttatcgggccaacaccgaagcccagatcaaattcaagttggctctccactacttcaagaactatctccaatgtgtcacctaaggtatccgggcattggaaaagcgctgagctgcctggttgcaagtatctaagacagcggatgcggtggctgggataccaatatttgaactcctcataagataagcactgtaatgcccagggagcagggtaggcaggtgggtctgactccgttactggaagtaccaataaaagtacagggtcattagaaatggaccagtcactgaggtgggcaatggagacttcattcataacgattacggcggtgtttccatcatggctcagaggtagcaatccagactgctatccacgaagatgcgagttggatccctggccttgctcagtgggctaaggatctggcattgctgtggctgtggcataggctggcagctgcagctctgatgcgccccctagcctgggaacttccagatgctaagtgtgtggccataaaaaaaaaaaaaaaaaaaaaaaaaaa

SEQ ID NO: 25 - protein, 502 aa, Sus scrofa
MTSYSPRCLSILKILMVLLVLSVGLFMFQSVFLDTDFSLLNSPIPSPTLDAQTLKLLPEKPDFYGENGLFPKNQCQCDAFGHQESYNLEDAYDPQDLPAVNLRRQAELEHFQRREGLPRPPPLLAQPNLPFGYPVHGVEVMPLHTIPIPGLRFEGPDAPIYEVTLTASLGTLNTLADVPDNVVKGRGQKQLNILTSSRELLNFILQHVTYTSTEYHLHRVDVVSLESKSSVAKFPVTIRYPVMPKLYDPGPERKLRDLVTIATKTFLRPHKLMTMLRSVREYYPDLTVIVADDSKEPLKITDSHVEYYTMPFGKGWFAGRNLAISQVTTKYVLWVDDDFIFNSKTRIEALVDVLEKTELDVVGGSVIENTFQFKLLLEQGKNGDCLHQQPGFFRPVDGFPDCVVTSGVVNFFLAHTERLQRIGFDPRLQRVAHSEFFIDGLGSLLVGSCPHVIIGHQPHLPVMDPELATLEGNYTSYRANTEAQIKFKLALHYFKNYLQCVT

SEQ ID NO: 26 - DNA, 58425 bp, Sus scrofa
  modified_base (5753)..(5852): a, c, t, g, unknown or other
  modified_base (9176)..(9275): a, c, t, g, unknown or other
  modified_base (18671)..(18770): a, c, t, g, unknown or other
  modified_base (26990)..(27089): a, c, t, g, unknown or other
  modified_base (45736)..(45835): a, c, t, g, unknown or other
  modified_base (48911)..(49010): a, c, t, g, unknown or other
  modified_base (52558)..(52561): a, c, t, g, unknown or other
  modified_base (52565)..(52664): a, c, t, g, unknown or other
ctcacttccccccccacccccgtcctttccctctgtccctttgtccctccaccgtccctccatcatggggtccacctcgggtcccaggctgctgctgctgctcctgaccagcctccccctagccctgggggatcccatgtgagtaatcacaaccccaacccccaaacaaggctgcttctgcattgggagtgggcacttgtgagtataggtctctgcaggtttagggtgcatgtacggtgctggttgattctgtggcttgtgatgaggttggggtgagtctcagaagttggggttgggtgagtctcagaagtttggactccataggatctgggagtttgtagttttagcatttaggagtttcagagatgcggtttggatgtatgtggctgaggggatggattgggttgtatttataggtctggggtgctagaggtttaggaggctgtttagggtgttccagggtttgggtatttagagacttgaggtatttaaagatttaggagttctgaccttggagcagtgggttaagaattcgactgcagaggccagggtcgctgatccggtgcgaccataaaatgataaaaaataaataaacgattaaaaaaaagattgaagggttgagacttctggaatttgtgggtttgattgtgggcttggaagtccatcgtcttggaggaattggttctgattttgaggttcaggaattgatgggatctgaagcccccaagctgtcctccagtcatcggatcccccgcagggctaggggctggggcagagcgctgaccctgggggtgcctagcatctcgtgcccctgggatgacagctctacgcctcgtcctcccctcccgcagttacaccataatcacccccaacgtcctgcgtctggagagtgaggagatggtggtgttggaggcccacgaagggcaaggggatattcgggtttcggtcaccgtccatgacttcccggccaagagacaggtgctgtccagcgagaccacgacgctgaacaacgccaacaactacctgagcaccgtcaacatcaaggtgggcgcgctcaacagccggaccgctgaagccccaccccttctttgagtcctcttggtagctgagcccctcctccctttctgagccccacccaccctgcctgagccccgccccttctgtctgagtgtctccattctgaaccccgcccctctgagtctcctccccttcggagcccttccccttttggagtccgggtcactttttggagccccctcccactctctcatcccggtctttctctgagtgtccccaccttctgagccctcgtctttctctcagcccggcccccttccaagccccaccatgtctgagcccttccccatttctgacccctcccctccaaccctcctccctaagtcctttcttcttttagaacccgtcccctctccgagtctcctcccctttctgaaccccctaccccttctgagccctccttccgctaagccccctgcctgaatcccccttcccatccctccctctgactccctaccccctctcttgccctttggcccttccccgagtacctcttctctccccaaacctgggcaaagcaggaggaccagaagtgacaagcaggctctgttgcgaggaggggcgggtgcggacccagccgaagtcctagaggctggatggtgggcaaggggtcttggcccctagtgatcccctggttcctgctcagatcccggccagcaaggagttcaaatcagagaaggggcacaagttcgtgaccgttcaggcgctctttgggaacgtccaggtggagaaggtggtgctggtcagccttcagagcgggtacctcttcatccagacggacaagactatctacaccccaggctccacgggtaaggggctgagggtggctgcagagagccaggggcagggctggaggaaggggcagggcctcacccggctctgcttttctctcccaccactgctcagtcctctatcggatcttcaccgttgaccacaagctgctgcccgtgggccagaccattgtcgtcaccattgaggtaccagccgactggggccccagacatacccagggcagggactcggggagagacaaagagagagagagaaacagagaaagggattccggcaaaggcccagcagcagagacataaaggcaaaaaacaaaaccccaaaaacgtaagggcacacagagagatcgggagagaggcggggacccagcgatgcttaccgtggatgacggctccagataagtccctggtcactgtgtgaatctggacaggtcacttcatctttccaagcctcagtttcctcatttgaagactgacacgacaggtactaattctatgtagtctgttccgcctactgcccgccagagggcgcgtgggagcacctgagtcaggttccacccctcctctgcctgccgttttccagggctccccgctcctggggtaaatgcccaagtcctccccacgggcctcaaggccctgcaagacctgctcccgcaccctgcccaccctcctttcttccctctctcttcctccctccgctccagccacgtgggcctcgtcaccgttcttgcaacaatccaggcacagtcctgccccaagacctttgcaggggttgttccccctcccccccaaatgctcttcctgcaaatatccacacagtttgctccctcacctccttcaagtctttgctcaaatgtcaccagtgtaccaattttacagtgaggcttgtcagagcgccctgtaaaattgcaacagaacacacacacacacacacacacacacacacacacacacactcccttttttgccttcctgccatctctttttggcatcttataaatcggagttatttcccccctcccttttttggtctttttatctttttagggccgcacccgcagcatatggaagttcccaggctaggggtcgatttggcctaggccacagcaatgtgggatctgagttgcacagctcacagcaacgcaggatccttaacccagggagcgaggccagggttcaaacccaagtcctcatggatacttgttgggttcgttaaccactgaagcacgatgggaagttttttggggtttttttttgtgggacctattcctttgttaactgcgccttcccccaatctgcactgaacctaagttctgttcagaaagggattatctgttggcccagagtttggcgggtagtagggtaaataaaaacttactggaagaagggagggagggaaggagaggggagtgagaagcagggagtgatggggagagaaagacaagtggaggaggaaggggaggaatggggcctgtcctccttgtgggatctttgtatttattgaaatcaggcaaacctaacaaggaccagagtttttgtgtgtgtgtggtatcagtatgtgtgtggggtttttttggtttttgtttgtttgttttttgctttttagggccataccctcagcatatggaggttcccaggcttagggtccaatcagagctacagctgctggtctacaccacagccacagaaaggcaggatccaaaccacatctgcgacctacaccgcagctcacagcaatgccggatccttaatgccggactgaacatgcaacctcatggttcctagttggattcgtttccactgcactacgatgggaactccaaggagcgggttctgaaggctgtgtgctcactttagtgatggtggaaaacagagaacaccctcctctaaagatgtggcgctgccagactcccattgaacgtcacctcatgccattgggaagaacatatccacaattacctccacttgccagagaagctagagaatcagatttctctttgaagtctcctgatgtttagctattggcaacaaatgaaatcatatacttattaggttgagccacacgaagttgctattcttgcaggtcaaaaaggtgaatgtaggcagtgatgtgtgccttctacaaatcaaatgctcagcccagggtcctatatcaaaggaggtgataaattctagtaattactagtcttcagagcgacacagatcatcacaagcacttgcctacactaacaggtcccaaaccagtgacacaggagctgtagttatctcctttttccaagaggttcacattgagcacaaagaggttaagtaatttgcccaagatcacacaggcttgtaagtggtgcagtggggacaggaacccaggctacctggtttgggtgcccattcttaaccactgcccctgtagacacgacacagaggagaaccaaggggctaagcctggtctctgaagagccacttcccttcctgtctcctcacagacccctgaaggcattgacatcaaacgggactccctgtcatcccacaaccagtttggcatcttggctttgtcttggaacatcccagagctggtcaagtaggtcgggccctccagcaggggtggggtggagtggtcgtgtgttttagggctccccaggagagggagtgggggggctgccagacctggcggactcactagcctgcctcccccacagcatggggcagtggaagatccgagcccactatgaggatgctccccagcaagtcttctctgctgagtttgaggtgaaggaatatggtaagaagaggagggagctgggggggggggggcgtgcataatgttggacccagcgttgaccccccccaccgaacgaataccatctgctcccccccaatagtgctgcccagttttgaggtccaagtggagccttcagagaaattctactacatcgatgacccaaatggcctaactgtcaacatcattgccaggtgagggtctagggggagggcctggggagagggaaggtcaagggatagggcagggatggagggggaggggctcgtcacggccagtggacatttgggggaagactcctcttttcaggaccgggggagtctgagaccccttcccactttgcaggttcttgtacggggagagtgtggatggaacagctttcgtcatctttggggtccaggacggtgaccagaggatttcattgtctcagtccctcacccgtgttccggtacctaacagtggccccctctgagtaactcttcctctccccctcggaagcccttcccctccctgagccctcgctttctcccccagatcattgatgggacgggggaagccacgctgagccaaggggtcttgctgaatggagtacattattccagtgtcaatgacttggtgggaaaatccatatatgtatctgtcactgtcattctgaactcaggtgaggcccgatctgagggcggaggctccgtaccaccatgtggtccagcctgagaggggcagctcagtggaggggagaggatcagaatgaagggcgacccagtctggtggggggcggtgtgtccagtctgagggaggaggtccagaatgaaggcagggtcgggtctgacaggggagacctaggctgggacacaaacccagtctgaggggggaggcccagtcagaggggggaggcccaaaatcaaggtgggatccagttcatgggggagacctagtctgaggaaggtggggtccgtgttgaggagggcagtctggccctccctcatggctggcccccctcaggcagcgacatggtggaggcagagcgcaccgggatccccatcgtgacctccccctatcagatccacttcaccaagacccccaagttcttcaaacccgccatccttcgacctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgtggtgtaggttgcagactcagcttagatctggcattgctgtggctgtggtgtaggccagaggctacagctctgatttgacccttagcctaggaaactccatatgcagtgggtgtggccctaaaaaaaaaaaaaaagttttccctcctgcaccagctccaacaccccaaatagtttggtgtgtgttttctagaaaaaaaaagatacaggcagacctcggagtcagttcctggccatgttaataaagcaagtcacataaattttttagtttcctagtacatataaaagttatgtttacactatgctatattctattaactgtgcaactgcattgtttaaaaaaatgtacatacctttattttaaaatacttgattgctatcagagtttcccagcggctcagcagattaagaatccagtattgtcactgctgtgactctggttactgctgttgatgggggttcaatcccctggcctggaacttctgcatgccgtgggcatggccaaaaaataaaagaagaaaaaaaatttaaaaattaaaaaatgctttactgctatcaactatacttcaaagaaaaaattgctagagtaaaaaataaatgctttattgctaacaaaagttaaccatcctctgataacgcagaggtcacaagcctttgatttgtttttcaaaaatgcagtatctgcaaaactcaataaactgaggtatgcctgcattctcctacaaacccacagtgcagtcattagaattaggacgtcaacattaattcattactaccctcaaatcctccatcaccattcaaattttgccagggttttgttttgttttgttttttggtgtttggggttttgaggttttgtttttgtttttgtcgtttatagggaaaggatcctgtccagaatcacaggctgtgttttctggttgggtctcttcagtgtccttggacctgtctgacctttagagcactttcttctttctgtgactttcacatccttgatggatacgaagtacacagactgagatcttggggactgtcccaccatctgggtctgcctgatgctccttcatgacagcactcaggttttgcatttttggcaggactgtcacggaagagacatcgtgtccttcttggtgcaccatttcaggtgacaaagggtactgatttatcccactctttggtgatgtgtaccctgattgcctgattaagctaatgtctgccgggtctctccattgtaaatgtcctctttattcctttttagttatttttaaaaacttctctttaactatcagatagtggcaaaattcaagtcaagagagatttccctccaaatcagtgttcacttagcctttaagacaacaggggtggattccttatattgtaatgtatgattttcaaacacaaccgtactttttttttcttttctttcttccttcctccctcctttcatcccttcattcttccttcctttcttctctttttctttccttcctttttttttttccttacaaaaaagcacccacctctcaaaggcagccattgattgccaaaatgggcaaacatttctaaattcctgtagtggaaagctagcagcccctgcagccctccaaaaagaaaaagattcccaatacacatgagcaaaggatcttcagtctctttgcactttataactaggcgtgctgctttctgctccagtgacccaagatgttcttttgcaaagaggaacgtttttttgcaaggaggaaatttagacaaaacatctgatttagaggggtacagtttacacatacgtggatttttttcaacattgtgtcattactttaaccagttgggggtgagccagaggattgattaaaagtcagtaccccaaaggcactttgatggattattccagagcgcagatggatttaggcatctctggaattccacctacttggttgtaaggcagacccagagccaaaataaaatctgttcatcatttttttgaggaaagcccagccagggttgaactctgttcccgcccagcttgctgatggtgtcaagctggcttttaaaggccacctcctctccagcagtctccatcaaagtccagggaatctttcaactcaccccattgctttcaggaaggacttttaaccatcagacacagcagcaggcatggtactcagggcccaggatgcttctggagggtcttccgtgcaaaggtttcattccctcaaaaaccaaagaagggaaagaaatcaatacaattcagcctggattatttttgcctttatgccaacacagttgtaaaatagggtttcccatatattttatggaagaaggagcccccagagtcaaatgggcctggggtccctggaagtgatcacatggtcatgggtgtgtggcagctaggaatccctccggggattgtagagatacgtgtctaaaaggggacagcgagaaagtgagtctgttccaaacctgggttgttcccctcctcccctcttcccccaaaaggtgacctggatgaagaaataatcccagaggaagacatcatttccagaagccagttccccgagagctggctgtggaccattgaggagtttaaagaaccagacaaaaatgggtaaggctgggatgaccctgcttcaacccccgccgccagtacccagggacagccccctctcatcacactagaactggacaatgaatttgcaggtacctggagtcccccttcttttctttcttgggggaatcccacaacccaacctaaaaaaatcaagcccttgggctatcagccactgccccacacactacagtccgttcctttcgcatctactaaaaatttatcttgtgtttgtttattcttcattcattatattttctttctttctcactgcctgcgctgtgactccttttctctctacattctgtttatcatcatcttccacacaactcatttcttatcctcaccaccaccactctctgctccaaattttgaattttacacccagactcctctctgctatgtgaagcgcctacaccccgtcactagtgttactctcttatcgctgacctcccttgtaccctcccatttatttcttttttttttttcttttgccctatctacctgcctctctttcccatcccatgtttgccatgttgaattatgtttatttaagaatatgtttagagagtgatgtctctattgatgatgactacctgctgtctctcatccgcgcgacatattcattatttataccatttggcgtacttcacttgtctaacacaatccttatccgtatataaagagatgatgaagaaccccccgcccgcccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacccactgagcaagaccagggatccttaacccgctttgcacagcaggaactcctgggctttttttttttttttttttttttgagccctgagattttttaatcccccccccctttttttggcttttctagggccgcacccgtggcatatggaggttcccaggctaggggtctaatgggagctgtagccgctggcctacaccacagccacagccacagccactcaggatccgagctgcatctgcaacctacaccacagctcatggcaacaccagatccttaacccactgagcaaggccagggattgaatctgcaacctcatgcttcctagtcagcttcgttaaccactgagccaggatgggaactcccttaaattcctgacatcttctcaacatcaactctcttctcaagatcaactctctctcatctcatttttttttttttttttttttttttcttttctagggacgctcccgtggcatatggaggttcccaggctaggggtcgaatcggagctgtagccaccagcctacagcagtgtgggatctgagccgcatctgcaacctacaccacagctcaaggcaacaccagatccttaagccactgagcaaggccagggatcgaacccgaaacctcatggttcctagtcggattcgttaaccactgtgccacaacgggaactcccaaaataagagatttttaaaaaccgttttaggattccagaaacaactgagcaaaaaaatataccaatggctgagtaatagtccatcatgtatctgtactacatcttctttatccactcctctggacacttaggttgcttccgtgtcttggctattgtcagtagcactgcagtgaacacctggtgcattcaaattatggttttcttcagtcttttccatttttaattcctttttttcctttcaaatagagagcaaggggtctagctttcctcaggcagcataagctaaccaatatttaacacaatcattctattttccttgaggacactcttatttatagcacaagaacctggtttctcacccatgtcctaaattaaatttaagtttagaaaaatttataaaaacaaatagtaagtaagaaatggtaaggagcaccagtgactaatcagacaccccgagggtgatgagtaaatgacagtaggttgggaaataaggattttgttcaagcctctgattataatttttttttttgctcttgaagaataagaacaatgcacaaatcttaatagatttcttagtgtaacattattaataatgtgttaacagtttgtgcagtttcacttgcatcagcactctgcttgcatttgatcaggtaatttttgtgtcatatataacattgttttcagcatcatttttgatcaaggttgttatcaaaattcaacggagtaaatttgaagatgtaattggctttattaaacaattcatgaattgggcagcgtctcatctggcaggcagagagatactcagaggagttgtgaaaaatggaaggttttaatagaatgaagtctagggcaagagagtaatcgcaagatacaaatttcatcattggaggaaaataacaattcaggtgggagaggatctccttggctgagctacagtattttcattcgctgggctttttactgggcaggaagaaagtcttccttcctcctgctgcagtaaatttcacttcctatttgggagtgcaaggtacttctctttcctttggggtctgtaattgatgcttcttcctgttgggatctgtaattgacatcttcctgtttggggtaattgacttgcttggtggagcattagagctccctctacaggccttccctacttcaatttagttaaggtttacttttactaatttttacaatgtaaatcagtgctgtccattagaaatataatgcaggttgtaaacgtcatttaaaattttctgatagccctgtaaaaaagggataggtgagtgagttcccttgtggcacagtgggttagggatcctgcatcatcactgcagcagcccatccctgctgtggtgtgggtttgatccctggcccaggaacttccacatgctgtaggggcagccaaaaagaagggatggtaggtgaaatcaattttaataatacattttatttaatccaaatatatcctaggagttctcattgtggctcagtgggttatgaacccaacttagtgttgtgaggatgtgggctggattcctggccttgctcagtgtgttaaggatccggcactacctcaagctttgcataggtcgcagatggggctggaagctggtgttgctgtgactgtagtgtaggctggcagtgacagctcagattcagcccctagcctgggaacttccacatgctgcaggtgcagccctaaagagaaaacaaacaaatatatccaaaatattattatttcaacattttgtaaaaacttgcaaaaccactatcacactgatactgttacaataataaatccattaatattttaaaataagctattaataatctcaaaattgtgatatcttttagttttatttgtactaagccttcaaaatctgccatgtattttatacttactgatatctcaattagaatgttagcttttcattagaaatactttgatctgtaattaccatccataaaatttacagttaaaaaggaaagtgtacccaagttgttgtaaatattcttttttctttctttttttttgtatttttgacttttctagggccacttctgcggcatatggagattcccaggctaggggtctaattggagctgtagccaccggcctacgccagagccatgtctgcaatctacaccacagctcacagcaatgccagatccttaacccactgagcaaggacagggattgaacccgcaacctcatggttcttagtcggattcgttaaccactgtgccacaatgggaactctgtaaatattctttaaaaagttatccagtcactgaatcaagcatccttttaaaaattgagatacaggagttctctggtagcctagcagttaaggatccattgtgccactgctgtggctcaggtcgctgctgtgatatgggttcaatccctggcccaagaactttcacatgccatatgcacagccaaaaaagtgtaaaataaaacaaaattgtgatctaattcacataccacaaaagtcaccctttgaaagtgtacaattcagcggtttttagtatattcacgatgcacattgtttttgttttttggtatttttttttttagggctgcacccacggcatatggaggctcccaggctaggggttgaatcagagctgcagctgctggcctataccacagccacagcaacaccagatctgagccatgtctgtgacctacactgcagcttgaggaaatgccacatccttaacccactaagcaaggccagggatcgaatccatatcttcatggatactaattgcatttgtaaccactgagccgcaatgggaactcctgcacagtgttttttcttttcttttttttttttttttcttgtctttttgtcttctctagggccgctcctgcagcctatggaggttcccaggctagggatccagttggagctatagccactggcctacgccacagccacagcaacaccagatccgagctgcatctgtgacctacaccaccgttcatggcaacaccggatccttaacccactgagcgaggccagggattgaacccgcaacctcatggttcctagtcggattcgttaaccactgagccacgacgggaactcctggtttttaagttgaaatctgagttaactaaaacgaaataaaagtaggaatccagttctcaactgagctagccacatttcaagtgcccagggtccacttacagtcatcattttggagagcacagatcagaaccttcagttatgcttgccttcttcccttctgcatatttacctatgaataacattacaaagaaaatgagaatttctctcacagcaactcccatccaccaccaccacctgtaagatatcactattaatgatgtgtctctgggctctgccagggcaggcggagcttgggacagctcttgtggtcaggggtgagccctgagatattggcagggtcaggaacttggacctgaacttggatccagcccaccctccctgccccctaccaccgacgctgtgttctgtttccacctgggcagggatctgcgtggctgacccctatgaggttgtggtgaagcaagatttcttcatcgatctgcgtctcccctactccgttgtgcgcaatgagcaggtggagatccgagctatcctctataactacagggaggcagaggatctcaaggtgagcctctagtgtgacaggcatgatggggagcttggagggagggtccatggcacactctcctgacttgatactccctcttcctggcaggtcagggtggaactgctctacaatccagctttctgcagcctggccaccgccaagaagcgccaccaacagactctaacggtcccagccaagtcctcagtgcccgtgccttacatcattgtgcccttgaagactggcctccaggaggtggaggtcaaggccgccgtctacaaccacttcatcagtgatggtgtcaagaagaccctgaaggtcgtggtgagtctttggggatacctgctgccccttgtccttcaggaaagactcctgtcttcctgtgctgtgaacccaggttggagacccaggctaagaatacggagtacttctcagaaaatttaggagttccggaagtttggaagcagggctgggattagggtgaggcaagtgaggcattctccttgggcatggaatttcaggggacactccaaagcttagtaacagagatcaatgatattttttcgttaaaatatagtttaatgtcaaatatgacatttcgtaacacatttcagcagaggagttttctcttgactaaaaatcttgggaggagttcccattgtggctcagtggttaacgaatccgacttggaaccatgaggttttgggttcggtccctggcctcgctcagtgggttaaggatccagcgttgccatgagctgtggtgtaggtcgcagacaccgctcgcatcccacattgctatggctctggtgtaggccagcgactgtggctccaattagacccctagcctgggaacctccatgtgccgagggagcggccctagaaaaaggcaaaaaaaaaaaaaaaaaaaatcttgggaaagcatatttcacagaacaaatattataaagccataacatacaatgctagaacagaggaaacgtctatttctacctatgattcttaccttaaaatatgcattaacagttacttttccatgtcctatgattaaacatataatagataaaatcaacaataaaaataaaagtattatcatcttttagtaacgttttaaagcaaaatgtgagatcataaacaagatcaaaaatatttaattcaagagtacctgttgtggcttagcggtaacaaaaatatttaattcaagagttcctgttgtggctctgactagaatccatgaggatgtgggcttgatccctgaccctgctcagtgggttaaggatctggcattgccatgagctgtggtgtaggtcatagaagcagcttggatctggcattactgtggttatggtgtagccagcagctgctgctccaattcaactcctaccctgggaacttccatgtgctgtaagtgcagccctaaaaagacaaaaaaagtaatgcaatatattaagaaatcaaaattaatgccccaaaccctcacaacaaacaaaatatcaaaattttaaatagagacaggatctgacagtgtcaaggcaaaccatattggagcctgaagcagaagaaaaatgagttgctccataaatgtgcctgtatgtatttttaaatggttaattttccccaaaaacattacagtagctgaaaaaatattgaaacattgaaaaccaagtgtattaaaattgacagagtgattttccattgaagtattttgtttatacccaaaccagaatttattataatttttctttattggctttaataaaagcaaactcatatttttttcaactactttactgttctggaataaaattaaccattaaaaatatgtgaaagtatatattttggggcacatatttttctttcttttctttcttttttggggggtgtctttttagggccgcaccatcagcatatggaggttcccaggctgggggtcgaattggagccattggcctatgtcacagccacagcaacgccatttctgagccaagtttgtgacctacaccacagctcatggcaatgccagatccttaacccactgagtgaggtcagggatagaacctgcatcctcatggatactggtcagattggttttcactgagccacgatgggaactccacacacatttgtccttttgccttgagtttctatatggctcagcttgggcactggtgagaagaaagccaggattttgttagagtttatattgcccagctcccaaaagccagtgtgcccatcacttcacaattctgtactcactgtggctggtagcttgaaaatcaccatgttgggaatatttacaccaaggaaattggcagcactacaaattaggaacttttcttcctgaaaagctggatgttatatatttaccaacacaccattggaggcatcttagtctgcaaaggaaaatctgggaattactaccaggtgaaaggagaatgagttctaggaagacaaaaacagccaccgtccaccatggagatttatgtgtagacacataagggcttgtagtgggcctttgatcctaattaagacagttctgattttaactgagcccttactatgtgctaggcactatgttaaatacttgtgtgaatcctttcatttcttttgtgagaggggggtctttttaggaccacacctgtagcatgtgggagttcccaggctagaagctgaacgggagcttcagctgccagccttcgcctctgccacagcaacgccagatccgaaccacatctgcaacgccacaccacagcccatagcaatgccgtatctttaacccactgagcagggccagggatcaaactcgggtcctcatggatactagtcaggttcattaccctgagtcacaacaggaactcctcatttcttttttctttactatttattctcatttgtttatttgaaaatgttgttttacttttaaattatttgttttattttacaatttttatttttattttagttagcctattgagaggcactgggttaaaaacagactctggaaccagactctcaggttcaaatccacactgtgttctactagctatgtgaccttgggcaaatgacttcatccatctgtaccccagttcccccatcttgaaaatggaagtgataatagcagtatccaccccattgagtcgttgtgaggattaaatgaattaaccccagtaaagaaatcttttaggcacataggaagatttctatagattttgttaggtcattattaacttataattttattattaatctatacaacaatgggtacgaggtagatgtttatattatgtctttataaggaagagagctgaggcacagacaggtgaagtaagtgacttccagtcacacagctaagatctagtggatgccatcgtgcatatgctacagtaatccccagaacaatgcctcgctgaccagctgtctgtctgtctgtccttttcttcacgggactccccctgcccccaacactatccagccagaaggaatgagagtcaacaaaactgtggtcactcgcacactggatccagaacataagggccaacgtgagtcagccacagaaggggtgagggctgggtggttgaggcagggtagggtgggaggggggtggttgaggcagggtaagagtgggagggggctggtgcaatgggtgtctcccattctcccggcagagggagtgcaacgagaggaaatcccacctgcggatctcagcgaccaagtcccagacacggagtcagagaccaagatcctcctgcaaggtgagaggcccttggcttcgaccccaggggacccagaactgtgttgggggggcatgagcccagttccatctcatccctcctcctcttcagctagaatttctctttgatctgcttcaggaaggctccaggcactatttagttcagccaatagcttttgctgatgaagaaatttattattttttaatgaatttattatatttatagttgtacgacgaccaccacaacccaattttataggctttccattcctaacccccagcacatcccctctcctcccaccctgcctcatttggaaaccatacgtttttcaaagtctgtgagtcagtatctgttctgcaaagaagatagatcattgtagctctgataaagaaatttaaataagaagcagtatagttccagagcagaaattctggatctgattgccctggatggggaactcgggcaagaagggacaagatagatctgaaaaggcaccttgcaacctgtaaggtgtaaagttttgggaggagacccttggttccctcatctgtgacgggggcaaataacagtatggttacctaagggttgttgggtgggattaaatgagatactatacagtgttctcttagaatagagcctagcaaatagcattaagcacgatataaatattcctgactattgttactggaattatgttaccactggtgtgtaacgagaggaaccagggactggaaatcccctgtgaagcacaagctcacccccaccactccgcaaatgcagaatccccctccagctgctcagctcctcccatcacataccctccagctgtccctgactcctttggccctggctggtcagagtctggaaatgctgggggcagccctggtcttgaatgccatcttaccgtctggctgcagggaccccggtggcccagatggtagaggatgccatcgacggggaccggctgaagcacctcatccaaaccccctccggctgtggggagcagaacatgatcggcatgacgcccacagtcatcgctgtgcactacctggacagcaccgaacaatgggagaagttcggcctggagaagaggcaggaagccttggagctcatcaagaagggtatatgccgcacctcctcctctgagctgtctaggcccctgagaccccgcccctccgagccccctccaaccagaggcccctcccctctagaggccccacctctctgagccctctccaaccagagactccgcccctctataggcaccacccctctgagcccctcccaaccaggggccccgcccctcctctgagaccacccccttgctcctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctatctgatcctcccactttctactttaagctccccttccccaccccaaacttgtcccctgctcagaaccctctctttcttctctgtacccctgtcccacctctcacagaatctttatcctctttctaagcccctcccctccctggcctacccatggtagccaccccctccactcagcctctgttgacacttctcccttctcggcagggtacacccagcaactggccttcagacaaaagaactcagcctttgccgccttccaggaccggctgtccagcacctggtgagtctccaagatctgcttgcccatccttagccttgcacctccctgagcagggcctggatcccggcctcaggtggtctaggttggcctcgcccacacagccctgtgcgacttgacccctctactcacgaagtcaaaacaccagccagatgagtggcctgcatgccacaccgggtcctgagtttggggaagagaaactgggcggaccaggccaggccccgcctctctctgttcattgcttggctgggatgcagtcttcggatcccagagccaattggctcatgctctgtgtccgcaggctgacagcctatgtggtcaaggtcttcgctatggcagccaacctcatcgccatcgactcccaggtcctctgtggggccgtcaaatggctgatcctggagaagcagaagcctgatggagtcttcgaggagaatgggcccgtgatacaccaagaaatgattgtaagaggaagggactcagagcaggcagggggagaggggcatctgagcatcacaggttagcggggtgggggggtgggaggaagactccaccatccacccatggcccaatccattgtgccaggggacaggggataagggagctgggagtgccactcctccattgcaaaaaacaaagacttgcaggatccggtgcaaaaggaaagttcccaggtcacagagctgcttagagccgtggtcctcaaagtgtggtccccaagccagcagcatcagcaccacctgcaaacttgttaaaaatacacattttcaggatggactccagaggcactgaatcagaaacaataggggcaacgtctagaaattggagctttaacgcacatatacacacatctctgctgatgctggtgtgtgctgaagttggagagttgctgccttagcctgaccttgctggctttcacacagctttctcctgccccccttcacactctacctggactgctagaagccttgctctgtccagccacagggcctttgaacatgctgtttctgctgcctgccctgctaacccctgccctctttgagagttgactcctactcactcttcagattgtggttccatctgtcacccctcagagacacttttccacgactgagtcactcttccactgtccattctcaatgccatctccacttctcctgcacagcactcatcagtttgtaattatatatctgtggatgacctggttggctcatgtctgtctcccctactagacagggagctccatgagggctgggctggggtctggttttctcccaccatcttatccacagctccatcaacatttgcagaatgaatgaatggatactaaagagcttggccctcttggggagaccctggggagagacccagccctgccttgacctgctgatcctacaggggggtggtgggcatgtggggacatgatgttcacccgctccgggcttcctgcttcccctctagggtggcttcaagaacactgaggagaaagacgtgtccctgacagcctttgttctcatcgcgctgcaggaggctaaagacatctgtgaaccacaggtcaatgtaagtgtcccttgcctctccctcctcccctcccctgctcaggacacatcaggtgaggtatggatttggggccatttccagtcctcccagtgtgacaaccaccatcacagtggccataagagtacctaacatttatcgagccattaactaagatactcacctaaaagcttcacatgtttaagtcctgtaatccttgtagcagcccaagagacaggctacccttattatccccagtttttagaagagaaaactggagctcccatcatggctcagcataaatgaatctgactagtagccatggggacacaggtctgatccctggccttgctcagtgggttaaggatctggcgttgctgtgagctgtggtgtagatcacagacgaggctcggatcctgtgttgctgtggtataggctggcaactatagctcctatttaacccctagcctgggaacctccatatgctgtaggtgcagccctaaaaagacaaaaaaaaaaaaaaaaaaaaaaagagagagagagagagagaaaattgaggcacagagagatcaaagatcaggtcctttccgcctgttctcccatttctagagagtcatagccaatttcagcagaagtcctctcagtttgctttccacagcactcctccacatgcctccttgctgcttccctagagaaaactcaagacacagagcttaaaaagaggagaaaaaaaatcctcaagaccatttccttagtttagagggtctttcagggtatttttttaaaggagtccatgatcccaaaagggaagggatttaaaatgttgactattcactgtccccttttcctctggctttggttctgaagcagagaagtttgaaaagacaggctctggagaatctgtaatcactccatctgctttgccctgggattttgaggctgggttgcttgactttagcttccctacaggggaacctcaggctctcatcttcagccagctgcttctacctcctcagaaccccagaaaagggatggaggggaggggccgttgcctttaatgcccaaaagggcccaggccttcctggttccaacctggaagatttgagagaaattatagtagaaatgagacaacactaggactaggcacggggtaggggtggggatgtcagagagaagtgacttcaaagcctgactctcaggcacttccccttcaaggccttaatgtgtgcatctgtaaaacgggtatggtggtctttgtattgtttaggactctctgcattgtcctagatggaacacaagtgtgacccagattatgcaaaaatagggtatttattttagggatccaagaatttatcaagtgcaacgataaaagagtcctcagggactctgccagaatgcttcgtttttcacgtcctcccatatctttccttcccttcttgcctaataattcaactttcctggccatccggcctgcctggccaaactgtcttccttggggaaatagaccaaagcaccagcagcagaatctcagtgacagattctgattggctcaccgtgggtcaggtgatcacctgtggaccaatcagctgagggaggcagtaggtcttagtgggcaactatgtgcgcttctggtgcggccttgtgagtggaagtgaggtgttctaacaacagtcatcgacaggtgtagaagagattcctgggcaggcaaaaggatcatttctactgtaatataacattttttactatacatattataatgaagtatggcataggctgtggaacccgactgctggcatttaaatcaggagtatgctgaacccatccgtgtaaaatctgtaaaaccagttgttaaatttccaggaatttgcaagctggctgttaaacacgatcgtgattaaattaaattataaacttacagtgaaaaactgtaaacattaaacagtaaaaacaggcgttcccgtcgtgacgtagcggaaactaatctgactaggaaccatgaggtttcgggttcgatccctggcctggctcagtgggttaagaatccagcgttgccatgagctgtggtgtaggtcgcagatgcggctcagatctggcggtgctgtggctgtggtgtagaccggcagctgtagctccaattagacccctggcctgggaacctccataagcctcaggtgcagccctaaaaagacaaaaaagatttttaaaaaaaggacaaaaaaaggagttccgtggtggcgcagtggttaacgaatccgactaggaaccatgaggttgcgggttcggtccctgcccttgctcagtgggttaacgattcggcttgccgtgagctgtggtgtaggttgcagacgcggctcggatcccgcgttgctgtggctctggcgtaggctggtggctacagctccgattagacccctagcctgggaacctccatatgccgcgggagccgcccaagaaatagcaacaccaccaaaagccaaaagccaaaaaaaaaaaaaaaaaaaaaaaaaaaagacaaaaaaaaaagtaaaaacgcaggtagtaaacacttaaaatgtatcacttcctaaacattttgctatcttttatcatggttcttttgagaatttatgtgtattgtacttgtatagtggaaatattatgtaatgttgaactactgcccatctcttcccaaatctacattcaatgatgtgggttgattgatggattgaaagcagccatgataatattgacatcatagaaatgacaaacccttcaaattatgttttcccccaacccctatctttctgggtcacagcatttttctctgacaggaggataatgatgaaaataatacctacctcatagtatattatgagattaagtgagcaagtatatgcctgggacatagtaagagctagctatgatggggattactctcagataagaagtgttcccttggtgagctgaatctggctcacactagctcacgagtgcctacggggggcatctctaccccactccatgttcagggacttcacattggtagcttaaaactgaccatggtagaatttttacaccacagtaattggtgatgcataaaggagcacccctcccccaaccccatgcctccattggagagctgattgttaaacattcaccagcacaccatggggtatacagactgccccccccatccccgctgccagcacatagtaggtactcagcaacaaagcagctcacaatgagaaaacttcaaaagtaggtagtagatccaaggcaggtcccaaggacagataccatcctggcgcccaggaagtgatgcttgtgtgatccttactagttctctgtggcagcaacgcccacttgatcagaatacccaatcctctttctcatagagcctgttgcgcagcatcaataaggcaagagacttcctcgcagactactacctagaattaaaaagaccatatactgtggccattgctggttatgccctggctctatctgacaagctggatgagcccttcctcaacaaacttctgagcacagccaaaggtaagaggcagcctggagagataaagaagggggtgcatggctagggtttgagggtggtcctctcaagctgggatgcatgcctctaagctgcactgggatgtgcatctccaagtggagctgggctggatggctctacaaggtgaaaagctctcattgtaaaccacacaggaaggctcactgcataattcatgacagcagtgaggtgtcattaagaacatgggctctgacctcaggcagactgaaaccgaaaccccactcagccactttctcactgcctgaccttggacaagtcatttaacttctctggaccttagtttcctcatcttaatacctacatcgcagggtggtcatgaagattaaatgtataatgcaagtagaagagagtctagcacacagtaagagctctgtcactgataccattagtgcctttaattttattttaatttttgtctttttagggccacacctgccgcatatggaagttcccaggctaggggttaaattggagccactgctgctggcctatgccacagcacagcaatgcaggatccgagccatatatgcaacctagctcacggaaatgccagatccttaacccactgagcaaggctagggattgaacccgcatcctcatggatcctagtcagattcattaactgctgagccacaaagggaatccaccttcaatattgttaaaaatattatcattatctgaaagcatagggaacttagcacagtgcctagcacagagtgagtgcttaatttttggtcccagctgatgacactgtatcatgtttgcactcactgatgtgacatatctcaagtaatggaatgtaacatatacaaaagtcatttaacacaagaataatttattggtggtggccggctctcctccacacagagatgcagagatctaggcctctatcttttcatagctctgccgctcagaatccatccatgtaagctgagggggaaatagtcaggaagactgtgcaagggaggtggaccaaacatggaaggggtcccatcattgctgtgcacattccattggtcaaagcttagttatgtggccatacctacctgcaaaggcatctgggagatgtagtccaactctgtgcccaggaagaggagggtatgattcttagtgacagcctctgccatcagtattttcttaggcacttgtgacatacagtgaatacagtgcagcccttcccattatggcctcacacctcagttgaggagggaaaatgaattaatagattactgtagaacattatagcattgggatagtagaagcacaggatgctttaacggacaggaggaagaagggcctcacttcctcttagggtgccattgaagctgaattgtgcggggtgagaattaaccacaggtagatggagaaaaattgctccaagtagagggaacagaatatgcaaaggctcataggtttaaaaaaaaaaagagcaagtttagggaatctcctgcagtggggctgcagttgagaattcaaatggaggagtgagggttgatgagggaagagagcaaggcagaagacagcagattgagggtcttgaatgtgggccaggacacttgaaaaccaagtccagtatgagtctttttttttttttctgagctttctctgagctatttacaggctgaacagagcattgagagtgggggttctctctgcagaaaggaaccgctgggaggaacctggccagaagctctacaatgtggaggccacatcctacgccctcttggctctgctggtagtcaaagactttgactctgtccctcctattgtgcgctggctcaatgagcagagatactacggaggtggctatggatctacccaggcaagtagccccacccccaccccacctccaccccaggcacctgcatcccaacctcttctggcctcccactagccttctggagtaggcactgagaccaagagaggtaggtcttctgtcccataagccaggatggttggaatgaagttgagaaatctttttttccccccttataaacccatctctggatctagactacattctgagtgctccaagctgtgttctgagcctctctttccctcttgacatctaggtcatgttctcagggctcaggttcagatgtgagcctctctctccccctggttccccagttccaccagattccctatcttatcctgtctcactggtaggttctagatcctgttcatctcaccagacccccaatattaccttgtctcattggtaggttctagactggatttttagttgttctgggccattatccaagcttctttctctcacttgtgggatctagaccatgttctcagctccttcaggctctcaatattaccctgtcttactgtgagttctagaaaagggtctcagctattctagcccccagtaggttctagaccatgggttctttagccccctttatttctagtgggctctcaatcacattctcagtgtttgggattccaaatcagatgctcagtgttcccaactttactcttttttaatgagtgggttctagacatattcccagcacttctagactcttgtcttagatgctctcctctagatgggtctagactactttctcactgtggctagactttcagtcttatgtctgccctttctggtgaattctagacatgttccccatgtctccaagctcttgtctgaacccctctcactcagagagttctagaacatgtcctcagtagccaacaaccctcgatcttgttcttgaaggccacaatgggtgggttcaaggccacagtttcagggccccagctctgatctgagactcttcatccctcagtggggtctaacaactttcttgttgcccagattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtagctgcgggaaactttcccagggaaacggtattccggtgtgaaatggtatggacaagaaaagctatttctgtgtgaaattgttatccgcaatccaggctctggaccccttccatgaattttctgcagtcctcatagtagtgcttcgaggtagggtgaccaagctattctgccattcctgagactctctcagtgttcgcactccaagtactgcatcctgggaaaaaccccttcccccaagacgggacctgggacccttggctgcggggcttgcacctgggaaatgtctccttgagcaacaacatacaaagaaaccaaatgggactaaaaatagctgcatgggcgttcccgtcgtggcgaagtgtttaacgaatccaactaggaaccatgaggttgtgggttcggtccctgcccttgctcagtgggttaacgatccggcgttgccatgagctgtggtgtaggttgcagatgcagctcggatcctgcattgctgtggctctggcgtgggccggtggctgcagctctgattcgacccctagcctgggaacctccatatgcggcgggagcggcccaagaaatggaaaaaagacaaaaaaaaaaaaaatagcagcatgcttgcacagttggggcagattatggacagcaagatataaaaagaccaaaaacccagctgccatatctgaggagccaggagcaaaagctgggtgctgtgcatgccctctgcacacagccccaccaagggggcaggcagaccacctaagccacccctctggcacccctaccctcaccccacttaaggaaccagctacacacacacacacacacacacacacacacacacacacacacacctgccccaagtaagggacacacacgcacatctgcccccagcaagggaatacttgttttcctttcttcctgctgcagcaggagctaaataaagccttgcctgaatttcttatcgggcctcttactcaatttctgttgactgggaaagccaagaagcctcatggttaacacccccagtctggggcaagccggaatggtcagtcactctacttcaaggtagacattaggactcccttttccagatgcagaaaagagtgcccaagagaggttgcctaactgttccaggtcagcccccaagtcagaacacaggaggagagccaagcagaccagaccacgctgggaaggagttcaggagatttgctcatcattctggctgtacccctcatgggctaccagctttgacccagctgcagcggagcctataagaaccagtgaatttgtgattctcagaggaggaaagggggagggggaaaggacagaagaagagggaggggaggaggagggagaaggggaggaggaagagatggggggagaggaaaaggaagagggggagggaagggaggcgcaggggaggaggatggggaaggaggagaggggagaaggctaacatattacacttatgatgttccaagtatctactaagcactgcctatatcttacctcgtttaatcctcatcaaacccctatgggattaactcctcttactctcatttccatggaaccaaagtcatggggcatggattggaacagccgaggtccccatgtcaatgaaccctggaaccaagatttgaacctaggcagtgcgactccagagcctatctcataacaactccccatggagttgaatcctcagaacttaatcccatcaggtaggcaggggttcatcaccctaccggataatcaggtgacaaaaccaagagatgaaggcatgtccccaaggtctaattgccttcaagctggggaagtctcttaccaaaatctgaccacgatcgccatggccactcacctgcaagcaaagagaagtctacagatccctttgatttttctttcctctcttttatggctgcacccgcagcccatggaagctcccgggctaggggtcaaatctgagcagcagcttccagcctacagcacagccatagcaaaacaggatctgagccacatctgtaatctgcgccacagatccttaacccactgaaggaggccagggattgaacctgcattctcatggacactatgtcatgttcgtaactcactgagccacaatgggaagtccctatagatccctctgagatctggccataagccatcctttcacaaccaggtaccctgtctccctgggtaccagtgatcacagtggtgagttatgaaagtgggaacgggatgtgaagaggaaaacccagtctctttctggggatttacctctatcagctcacgagttcttcacactttgccaggtaagaaaggatgggataccaatgttcattgccgccctacacacagtagccaagacgtggaagcaacctatgcatccatatgcagaggaatggataaagaagatgtggtatatacatacagtggaatattattcagccataaaaaagaaggaaatcatgccatctacagcaacatggatggacctagagattatcatactaagtgaagtaagtcatacaaatttacagttaaccaaggggatagcagggggtggggaaagataaattaggatttggggattagcagatacccactgccatatacacaaggacctactatatagcatggggagctatattcaatatcttgtaataacttataatggaaaataatctaaaagtaaacatgtatgtgtgtgtgtgtgttcactttgctatacaccagaaactaaaacaccattgtaaatcagctataattttttttaagggtttgggagttccctggtggtctagtggtaaggactcagcactttctccattgctgcccaggttcaatccctgatctaggaaccgaaatcccacatcaagctgctgcacaccacagccaaaaaaatgaaaaaaaaaaattttttttgtctttttgctatttcttgggctgctccagcagcatatggaggttaccaggctaggggtcaaatcagagctgtagccaccggcctatgccagagccacagcaacacaagatccgagccgcgtctgcagcctacaccacagctcacggcaacgctgggtcgttaacccactgggcaagggcagggatcgaacccacaacctcatggttcctagtcggattcgttaaccactgcgccacgacgggaactccaaaaatgaaaatttttttaaaatttttaatggttaaaagagggggggaatatcagccactcttggccccacccgcatccaccttgccaggttagcatcctatcccccgctgtctcactagccttgaagcactgcctgacacatccaggcatgtaacagcacagcctccgagcaggtgaacctctgtggtataattcacactccagagctcctcctgggaccaggctgcggctgaaaatctcctgaaacaccttctgagtggccatttcctcctcctgccccatcctgcttccctccctgcaagggtctcctgagagccctccctcaacaaatgagtcacataaaatcctcatctcaggctttgcttctccagaaatgaatgaaaaacaagtggcgatccttatttttgtgtttcagttttgttttgttttttcaaattttgaaggtctcctgtggtgcagtggattaaggatcctgtgctgtcactgcagcggctcaggttgctgctgcagttggggagttcaaaccctgacccaggaacttccgcatgccatgcatgtggctaaaaaataaaatgttaattgaaggcacaagggaaagagccagggtgggaaccaagagacctgatgttatcccttgttcggccaccatctcctagcaagtggccagctgtggttcaacctcctgggacacaagtctcctccccaccacattgggcatatgcattttcctcgtgcaacttacactgtgccattgactccaacggagataacgtgaatattacccagctgtagaaaccacaacaccctgtcggaaagaaaaggaaaacaccatgaaacatcaagaagctctttagattcaacctgaaaaattacttctggcacggcttcatggaaacaggtttggggagcctagatgaaagctgcagctgagtgatatacgttgttcaatataatctgcacaacaaccattcctgcttttctgcatgtcacttctgtttttcattctgtttatattatcttcattttcttttcaaagagttctagctgattttcaaaaatatgcatttaagtatgcgtcctcaaagggaacgacatctctcctaaaagggcaaaactggagttcccgtcatggcgcagtggttaacgaattggactaggatccatgaggttgcaggttcgatccctggccttgctcagtgggttaacgatctggcgttgccgtgagctctggtgtaggtcacagacatggctcggatcccgcgttgctgtggctctggcgtaggccagcggctacagctctgattagacccctagcctgggaacctccatatgcggcaggatcggccctataagggcaacacgacaaaaaatcagagaaaaaaaaaagggcaaaacttggttcttggggaaagatgaaaaacattgtactcttttatatacaagacacatagatatacatataccatataaataaatacacactatatctgtagtattattttttttggtcttttgtctatttagggccgcacccacggcatttggaggttcccaggataggggctgaatcagctacagctgctggcctccaccacagccacagcaacaccagatctgagctgcaactgtgacctacaccacagttcacggtaatgccggccccttaacccactgagcgaggccagggatcgaacccgcgtcctcatggatgctagtcttgttcatgatgctagtcttgttcattaaccactgagccacgatgggaactcctgtagtattaatttttttggggagagtaagacaattcattttttttaatgtctaaaaggcagcccagtcccccgtatttagttcctctccaactacatcatcatcatcaccctcatcatcaccatcatcttcagcatcaccatcaccagtctcaccagcatcttcaccaccaccatcatcatccccatcattatcatcactgctatcaacctcatcattatcttcagcatcaccatcatcaccaccaccatcatcattatccccatcatcatcatcaccatcaccagtgtcatcaccaccactctttgtttcttgcgggcagaataaagagtgctaatggcagggagttcccgtggcgcagtggttaacgaatctaactaggaaccatgagattgcaggttcgatccctgggcttgctcagcgggttaaggatccgcgttgctgtgagctgtggtgtaggtggcagatgcagctcagatcccacattgctgtggctctggcgtaggccggtggctacagctccgatttgacccctgtcctgggaacctccatatgccgtgggagcagcccaagaaatggtaaaaagacaaaaaaaaaaagagtgctaatggctaatcccagtgctgacacccccaaagaaacaaggccacaattcaggatttggggtccacagtcacctgctctttctaatgaaacctgccactcaacaagtctcacaaacctaaacttccaacttccctcagtatcactaattgaaatttctcttgctctttagttattttagaggcaacagagcatcatgtttaagcatatcaactctgacatcacatgtttggtgtcaaaatctagcttcaccaattacagactgtgcggccttgggaaagttacttaatttctttgtgcctatgttttctcttatgtgtaataagggaaacaaatccactgtacaacagctgaggaaacccacacttgttgcttagaaaaggtctcctattcttagatttgaaccaatgatgaaaactcacaagacccatgaagggaacaatgacatgaaaaaagcaagaccaagaaaaactgacacctgaagaaaaagaaataaaagaacaggaaaggagttctcatcttggagcagcagaaatgaatctgactagtgtacatgaggacgtgagtttgatccctggcctcgctcagtgggttaaggatccagcgttgctgggagctgtagtgttggtcacagatgcagcttggatcctgcattgctgtggctgtggtgtaggccagcagctgttgctctgattcaacctctggcctgggaacttccataagctgtgggtgcagccctaaaaagaaaagaaagaaagaaagaaagaaaagaaataccttccctggtttcctccttctatataacccccgatcacactatacgacagcttctttcatagctcttatcacccctggaatgccccgttttatatattcttcggagcagcatagtttaggaataaaacatacagactctggaaccaggctggctttaaaaccctggctctactcccttattacataagtggtcttgggcaagttattcaatttcttttacctcatttttttctcctttgtaaaatgggactgtttcaggacccaatatcagaggaatttagtgaagactgaatatgttctctatttgaggaacttagaacagtgctaagtgagtggttgctattaccgttagtggcttcctttctgcctacctcttcctgctggtaagtcagcctcacagggcaggaactttgtctgttcactgctctatcctcagtgcctagaacggcagctggtacacggtgggtgctcagaaaatacatgccaaatgaaggactataaagaaattctttcttggcagatgaattccctgatttttatcaaagctttcctgatgaagatgtttgcagtgtccagtctagaattatgatctcttggctggatagcccaaggccctcccttttccctgcagcctatatccagtgtaatcttcccccggactccctagtcagcctcatactcaccccaaaagagaaggaaactgaagctccacatcttgctgtgtttctgtcattcgaagaggagaatcttttctctgttcccagagtttttaataacagagggtgtggagagaggggaagggcagagccagcattgctcaatgcaaccagagcatcacagccctttttgctgagttgccaccactcggaaaggacagtgtagcaaacccctaattttctcctttctccacagtgtagagaggttggtctggctggtgggtcagtgtgtggatccatctccctctctctctctctctttccttcctgctggattctttctttcttttttttttttttttaattgcagcatagttaatttacaatgtatacacatatatattctttttcagcctttccattacaggttattataagatactgagtataatttactgtgctatatagtaggtccttgttgtttatctcttttatatacagtagtgtgtatatgttaatcccaaactcctcatttatctcccccttccactttgttctttccccaccaacatctatctcccatttctcatcatcttattttattgcacccagtaataaatgagcttccaccatctatccccaatgaagcaagagcaaaactcaagggtcctttcccagttttccccgtacaataaccaccataaacctcaagtaccaggcactgtgctaaatatgtttccaagaaaatttaatttcatcgccatgtcagcatcatcaagtagggattcctacccctacctatctcatttaaaaatacaatagaatggaaattgcaactaccaaccccaagctccctgtcaactattacatttagaatggatgagctaagcaatggggtcctggctgcacagcacaaggaaatatgtccagtctcttggaatagaacatgacggaagacagtatgaaaaaaagaatgtatatacatgtatgtttgggtcactatgctgtgcagcagaaattgatacaacgctgtaaatcaactacactctaataaaaaataaagaaagaaaagttaaaaataaagatgctagaaacaaaaaagaaaaaaggaaactgaggcttggagagaagatgtgtcttgtccaagactacctggacttgagatttgaatccaggaccctctgaccccaaagactagaactttcaccattttgtttgccttcagctccccataatatctgatcactgtcggtgacactcccactccatcccccctccccaagcccaaccgaagacacacatacacatgcaacttctcataaacagggtggcctaggaatatcttagttagggtctcccagatgcagaggctgagacaaggcgtctagtgaaagcagttcatcagggaggtgaccccaaaaacgctccagctgaggatgggagaagtgagagaaggaaggaaaagagcccacaatgaatgttatccagtaagttacccagtaaaaaactgaaactgaaacagaggttgaggacatctgtgctatgtagtaggtccttgttgtttctctcgtttatatgtaattgtgtgtatatgttaatcccaaactacctaagagacagcctaaagcaccctcttcagacttatcccaaacgaggcgggtgagggagctggggtatttatccaccagatgctgtcggtcactgattgaggcttgtgttaacttaagacctggcctccaagcagatagaatgcgctccagaccatagccctgttgatgacaaaatgcagtggctggcagatgtcaggctagggcacccaaatcctgtgctccaagataaaacagaagggcaaagcccagccctgaggtcttgggaagaagagccccatttgttttcatattctcctttttcgctctgggcaaggcaaaatacctaccctggaattatggtcaccgaagaagattcatcaacagctccatctgtggatcaagagaccctatccagtgaagctgcagctaagaacgagcacgaaaatacagcaaagccctccaagaaggaggataaacagagctgtgttacatttaagagacacactggtggatcaacacagaccctagcaccagatcgcaggggatttaaatcccgactccaccacttgctagtcatatgcggtcctgggcaacttcttaatgtctctatgcctcaacattcccatctgtaaaatggggctgataaaaggagaatctatttcatggagttaagatgagcatcagaggagtgggtatatatctcacgcttagaaccaagcctggcacatagagaaaactccaagatgtggctattactcaaattctttgatatttctcccttccagagggggaacccagtttttctctccttgaatatgagctggactcagtgacttgcttccaaggaacaggaaaaggaagatgtgacgtgtggcctctgaaacatctgaaagtcattgtggcttccccctcgctcttactttccaggatcattcagttgggggaagctagttatcgtattgtgagttcactcaagcagcgtgatagagaagccctcatgaggaggaactgagattccagccaaaaccttgactgtgacctcataagacactctgatccagccccacccagctaagccacctctagattcctgaccctcagaaactgtaagaaaataaaagtttgttgtttgaagctgttacatttggaggagagatgtgttacactgcaggagataactgatacgcttagaaccaattgtccttgtcaattaaaaaaaggataacaataacatcataagagtttgaggtttgctggaataaaaccttaaagttctacctggcaaaataatgcccactaatatcagtaattcttgttattattattatcccattaggctaagtggtcacagctactcattggcatctgttcctgggtaccagcaaggacagaagtcagcaacccatttcatgcaagaccatctaatgtgggtgagaaagtttagactttctctgctgggcaataaagggatttcagcaaaggagtaaccatcctgttggtagtttacaacactcgtgttgtgtagacaggatgtggtcatgggtggggagatggggagaagaacatagcgacaagctcgtctagggcacgggttgtggagacagagaggaatttaggaagcaggaaaagcagaatggggggaatgcatgcatgtgggtgggggagtctaaagcagaaggaggaattgacctctggacattgggctacagaattgaaagttcttcccatccggcccaggctccttctcggggtgggatgggatgggatgaaatggtggaggagttttcccgctactgccaaaacaaatcgccacaaacatatggcttgaaacaatacaaatgcaatacacgacaggtcgggaggtcagggtccccgatgagtcttaggaggctgaaatcaagatatccatgggggctcctagaggctctggggagaagtccattccctgtctttgacagcttctggaggatgcccatattccttcgcattccaaagccccttcctccatctgcacaggcggtgtagtatctcaaaatctctctcctctccctctctctctccttctccctctttctccctctctttcactctctctcccttcctccctccttccctctctccctctctttctctccctccctccctcctctccctctctcacacatacacacatacaaacacacacacatttgctccatggatggatggatggataggtaggtggattggtgggtgggtaagatatagatggatcaatggatgaataaacaggtaagtagatgtgtgtattatgctttgatagagagagagagagattgctctcattctctagatacatttctctcattctctctatcctcaatttctctctctcccccacctctccctcccctttcctctctgaccctccctccgctcccttaaaaggactttgtgattccattagacctactcagataatccgcaataatctcctatctcaaaatctttaacttcactgcacttgcaaagcccccttggcagtgtaaggtatatatgtacagctttccaggagtgggatatggacaacctggtgggaattagggggaatttcattattctacctactgaaggtggggtctggggtcctggtgcgtgactgaggatggcaagatgccagtcacccttcaaatccaaaagaggtgaccaaggctatgaactctggaccacagagatcctccaggatgagggcaggtagcaggcgtgaggggagaaaaaagggaaggaaatgcacaattggagccacatggcttgcagaagcctaaccccttgtgactttcccagcaaagaggaaattgagagatactcaagaagtcatctgagggtgtaataggaaagaacaaatctgactccatattagacctgttccttttactttaacctttgtgtcctgttgttttccctgaaagaatgttacctagagcctgaaattcatcccccagcctgcatagtctcaagcctctgacctttaagagtataacacgtttccattcacatagagataaaaagttgcagaacagagaattacatttgttttgttggaaccttacaggaacatcggtgacctgacctatgcagacaaaggactcctgtaccaagaaggctgcgacaaccaacctgccctgccccacttcccctggcctttaaaaatgctctgctgggtattcccattgtggctcagtggtagcaaacgtaactagtatccttgaggactctggggttcgatcccccaggcctcacttagtgtgttaaaggatccagcgttgctgtgagctgtgggataggttgcagatgcagctcagatcctgcgttgttgtggcaaaggctggctgctatagcttggattcaactcctagcctgggaacttccatgtgccctgggttccgcctgtggaaagtaacataatgtcttttctatcaaaggaaatcttggttactccattttgctcaggtttcaccttcctgcgaccccccccacccctcccctttccctcttctcccaataacaatttgtttcaaattagccagccgggaagaatgtgcaccctgacctgaccaatgggaaggggacaggtacatcacctgcgttagggataaataggggagggtcctttgttcggggcgcacactttttggagtggctgtgcccttctgcagaagtaaagagccttgtcgagatttctccttgtccatgtgtctcactttctgacactgacgacccagcccgagctagagttattggaatttccaacaggccttaaaaaaaaaaaaaaaaaaaaaaaaaaagacaataaacatgctttgctgaaaccctttgggaagttccgggtttggcagtggcggggggaggtgcatgagggcccttcccctccagcccccgcccaagtctccttgcacagccctgcaataaacctctctctgctcccaactcccctgttttgtatagtttggccgcactgagcaacaggcacatgatctgagttcggtaacagagaagcccggccccagagcatccctgggttcatgcttaatgagggtgttggaggaagggcggctcctgggaagccctccctacccaactggaccgtgttcctctctcgttccctctaaaccctcccctggctccctgtgaccttcgggatgaagtccagtctcattaatacgacactcaagacctcactgagtcttatactggtgcccttcttccttattgccccccctcacaagtcccagtcatcccaaatgaacctgcagtgcacactgtcgctgacctgtccagccatccttcagctactggagcaccatccccccgctgctgcgggtgttgcctgctaacagttcacagcttccccttctccagagaacgttccagttcaatgcctgcataaaccctcaggcccatcctgcagccaataagcaatgggcacaggggtcaaaagccagcgttcaccccaaggtgacttcaacttagtggtgttattcaggctccgggtgttggaaattacagtaactctggctccggttgtcagtgttggaaagtgagacacatggacaaggagaaatctcgacaaggctctttacttctgcagaagggcacagccactccaaaaagtgtgcgccccgaacaaaggaccctcccctatttatccctaacgcaggtgatgtacctgtccccttcccattggtcaggtcagggtgcacattcttcccggctggctaatttgaaacaaattgttattgggagaagagggaaaggggaggggtggggggggtcgcaggaaggtgaaacctgagcaaaatggagtaaccaagatttcctttgatagaaaagacattatgttactttccacactacccttcctcatcctctgctaaatgtcctctctcaataaaccctgaaacaaacatcctcagggcagagtctgtttccagggggacctaagaatccctcccagccattaaactctaagctgtctcttgacctcaggttgcacatgggtactcactccatattgtaggcttccttcccatgtcaatatcacctcctcttccgtgccttcctttgtcaatctcaccgcctctaggaagccttcccacaaaaatatcacctcccccagggagccttcccatgtaaaatcacctcctccaggaagccttcccatagaaatatcacctccagaaagccctccctgacctctccttcaggattagggacttcttctatgctttcctaatcccaacacttaatatgatctttgcttgtttctggatttgggggtgggggtatgcttgcttttggttttttctggggtttttggccgcacctgctgcatacggaagttctcaagctaggggtcaaatcagggctgcagctgtcagcctacaccacagccacagcaacgccagatccgagccacatctgcgacctacaccacagctcatggcaacaccagatccttaacccactgaacgaggccagggattgaacctgcagcctcatggatgctagttggatttgtttcctctgggccacaacaggaactcctgaaaaaactaaaaatcttaaaaaaaaaaaaaaagaaagaaagaaagaaccaatgaggaaaaagaagaaggaactgaagaatctcctgacatccccccctaagccctcagaaccaagaccaagaatgtaaggggatggccgatgggcagccactgccctccccctggaaggaaggaacacgagttctgcaaggggcagcacttgctgaggggcagagtcccagcttgctgggaaggatgcatagttatccaggctcctaagacccctggcaagtggagagggggggttgttgaaattcccctagaaccacacccaggtcaaagattccccaggatggctacacaactcagtgcatagccatcctcaggctgctttattacagcgaaaagatacaaagcaaagacacagaggaaaccaaaaatgaggaaagggttgaaatacatacaagcttccagcggagaggttcccaggagaatggaagaagcagcccccatccatcaattccttttgctgcgctgatctcggtatgagactccgaccccaaccatcctctcccgttgtgtgatttttttcctttcccctataattttccctgccatgccacccctcccccaaattgtgtgaccttcctttcattgtccttgccacaagttcccaccatgaccctttacaagagtaacatctcaggcgttcccgtcgtggctcagtggctaacgaatccgactaggaaccatgaggttgagggtttgatccctggtcttgcccagtgggttaaggatccggcgttgccgtgaactgtggtgtaggttgcagacgcagctcagatcctgcgttgctgtggctgtggtgtaggctggcggctatagctccgatgcaacccttagcctaggaacctccatatgccgcgggagcagccctgaaatgacaaaaagaaaaacactaaagtctcctcacagttggagctgctactctcttgagctcagccctttggttccggaggccctaataaatctctcttcttgactgacttggccttgggcgttcttccttcgagcaaacctaacaccagggtggcctggaaccagaggggcagggcgggagggatcacaagagagctccagaaaatttagggaaacaatggaaatgttccgtatcttgagtgtggccaaggttgccaaactcatccaatttttacactgagaaacgaagcagtttgttgtatgtaagtcaccctctcgtaaaatggataagcttggctccaaaataaaagaggacccagcattccatcaaattattttcttgtgcgtgccacatgaaaggacccagttgtgttattgtgcaggcaatatataaagggaccagtttattttatgctatataaaagggaacaaaagatgggcattttgagtttctccagggaggtgtgggctcttttacatttaaacatttgggttttttcgttttgttttttttttttttttgcttttcagggccacaccggcggcatatggaggttcccaggctaggggttatttcagagctacagctgccagcctacaccacagccacagcaacaccagatccgagccgcatctgcgatctacacccgacagctcacagcaacactggatccttaacccactgagtgaggccagggattgaacccacgacctcatgtttcctagtcggattcgtttccactgcaccatgatgggaactcctaaacatttgtttaaatggatagcttatcttattccacaataataaatacatttgaccttaagaagcttaggaatgatctaaatctatacttccttcaaaattaaaatgaaaccaaaaaaaaaaaaaaaactagtacagttcacatttcctaactgcaccctgacagataagaaatgtttcttagaataatgccatttgcagcaatatgggtggacctagagattatcatactaagtgaagttagtcagagaaaaacaaatgtcatatgatatcacttgtggaatctcaaaaaatgatacagaaaattccttcgtgattcagcaggttaaggacccagcattgccacagctctggcatgggtttgaaccctagcccggcgaactctgcatgctgtagttgctgcaaaaaaaaaaaaaaaaaaaaaaaaaaaattaattaaaagaatattttaaataaagtgttaaatgatataaattaacttatttacaaagcagaaatagactcactgacatagaaaacaaatttatagttaccaaaggggatagtgggggtaggggggagataaattagaagtttaagggttaacatatacacatcactatatataaaatagatcagcaacgaagacctactgtataacttaaactatattcaacatcttgtcataacctataatggaacagaatctgaaaaaggatatataaacatattatataagtgaatcactttactgtacacttgagactaacacaacgttgcagattaactatacctcaatattttaatttcactcacataccctgccctgggacttactaactctgacgaaggcatccacaggtgatattggtggacatatttcaaacacagccaggcagatatggcattgaatcaaacaggggcctttataaacatctctttctctctttataaacatctctttctctctctctctccacccccccaacacactctcaaacacgcgagagcgctttccaacgcagatagcaccaaagtaaagccaagcttgccctctggtggacagtatcagtagtgtcccaaactgctgggctgatacttggatcccagcttggtgaaagaagtagagagagagagagaaagagagggagagagagaaagaaaggtgtatctgtgcacctgagtttgttcacaagcctatatatatgagcccatatttgggcaccataaagggcccctgatgcttatggctttgtagcatcctcacactgcccagtggtatctcccattcattcacccaaaagcacagagaagggacttatagagtcatttcagagtcttgttggacacaagcagtcatagcctcatgtagccaggatggggcaagaggtagaaacacagagctggaggaagctagagggagagtttggatctaagtctctgaagggtaaacatgggcctatactgttgcaaaggcagagaaacctattgtagatggagtgggctctactcaaagccttttactgtagcacaaagcctcttcttaattctttaatcccttccagagggctaggtttgggctgttgagttagtacttggtatcttctagaagagaaatgagtgagccaaagaaatgactctctaatggtggaatgacaatgaagtcaggcatagggcagattttctttctttttaaaaacagttttttgaggtaagactgaaacatacaaattgtacatattgagtgtatacatagcgataagtttggggatacacatccacttgtgagaccatcaccaccatcaaggccgtaaacatacccatcacttctcaaagtttccttctgcagtggattttcattttggggtcccatcacatttcatggggactgttgacttgaggaaagtctgttctcagggagccagcactcctgtttgagttgcgggggagtgtctcaggtcccatgaaatattttccccgctgcctccaaactcatcagtttgaagctgtgtgctgctctctagtggccaccgctcatttggctctaagctttccgcatagattgttctgggaccagactgaaagcgcaggctccaagtcaggcttacaactttgagccttaaattgcaggaggtggggagccatggattaaggagacttaatcagtggacaatttgaggttttaatcagtgtggccatttcacacttgacctggcagatttccattcattagtatcatcacttggtctccagtctctcccatttccaatctattctgcaaaagcacaacccaagtcatatagtccaggcagcagattgaatccttaggatgacccacagggacttatgtaatttgcatcctcctcttgatctggctgcactgacctctggaagcaggaaagggcagaagaaaaagctgagcaaatatgcgggctcagcttgagtttacttagaattagtttcatggcgaaaattagtgtagaggagcaaggtagagagtatcttgatggtggtgggtggttattattgactatgtggtcagagaagccatcttggacatttgagctgagaccttgagtgaatggagagagtgcccagggaaaaggggggaggagaaaatgtgtgttaaggcagagggaatagcaggtgccaaggctctgaggaggctgttgagtcagtaccctgtattttctggaagagaaattatttagcaaaagaaatgactctctaataatggaattttgggcaatgaagtgagacaaggaacagattttctttttctgttaaaaaccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcccgccccgggccctgggaggggaagccacccgaacgcctcaaacctttgctctggaagccccaggaatttttccccctctcctagccgggatatatgacccctcctctttctggggtggtggtaatcctgggttcctgggcgccctggggtaactagatagcccctcgtgccaactctgggatttcttttggaggtgcagtggagtcagtgagggaaaccaagtcacccctcgggggggacccgcggaagcatggcgaccgggagaacctggtgcctgctctctggccgttctgggggccccccaagctgcggggaaccctgtccctctggccctgactcacgccgggccggccggattttccggaatctgggggggattaggggagccggggcagggggagtggccttgccccattccacacccctgttggacgtctggagaggggacactgtagtccggctggggccccgcccctgttccctggcccttcctgggaaggggagggggttcccgccggtttcctgcttccccccaccccacgccgctccggggcggggccgggaagccactccttctgggagctcagagcttggaggctcccctgggccaggtcagcgggctgtggggtcccaaagtcttgatcccggtcctcccaatcccccgctaggatcagtttgaggtgcttgagcggcacacgcaatggggtctggacctgttggacagatatgtgaagttcgtgaaagagcggacggaggtggagcaggcttatgcaaagcagctgcggtgagaccctagggtggccgcgccctgggcttcgggggagcggttggagggctgggggctcagtcttcctgcctctctccgtaggagcctggtgaaaaaatatctgcccaagagacctgccaaagatgaccctgaatccaagtaagaatgaagaggggaggcagagttagatttgggaggactggggtattggatccttttcctctccctccatttgggccacccaagcactcctggcttctccacccagttccacttagaggtatgagctgggaaccaggaaccgtattacctgggttggaattcaaaatccactactttctagctgaactgctttgggcagttgactccagttctccgcctccatttttcttgcctattaaatgggagaggctccaacagttattaaatgaatgactctgagcaagtgacttaagttttgtgcctctgtcttcctcactgtgaactggggatgatgatcacaatactgatcataatgataatgaccttgtaggggctcatttgaagattaagataatgtgttaaaacaatgcccagcccatttcactttattccaagcccccagttccagaatccccaaagctctaagaatcagaagcttttctgggcacctatccagaggcaacctctgacctgaactaatttgacattaattacattaattgcgttcttggtttttatcccactgagtgtgaatgttaatacttatcattgagagttcccgttgtggctcagcaggttaagaatctgactagtatccatgaggatatgggtcagatccctgacctttctcagtgggttaaagccctgtgttgccatgagctgtggtgtaggtcacagatggggcttggatcctgcattgctctggctggggtgtaaggcctgcagctgcagctccaatttgacccctagcctgggaacttccatatgcctcaggtacagccctaaaaagagaagaaaaaaaatctcatacaaaaatgtttattagatgctgccactaacaccactagggtaatgtgaaaagtgatataagcatcatatcccccttctgaacccccctcaaaatcctgagaattctgagttccccctcagcgggtggggataagggagattggttagaatttatcattgcttctgggtgaatgttttggagcttacactcttctggggcatatggcttccaagggccctgacccctagcccctgcccccttccccccaccccaggttcagccagcagcagtcctttgtgcagcttctccaggaggtgaatgattttgcaggccagcgggagctggtggctgagaacctcagtgtccaagtatgtctcgagctggccaagtattcgcaggagatgaagcaggagagaaagatggtaggtgatgccctccttgggacttccccagggccctggccaccaggctgagccttattacccccttctttctgtagcacttccaagaaggccgccgggctcagcagcagctggaaagtggcttcaagcagctggagaatgtgagtttgtgcatggggagaagaggggcacccctgagcagtggggtgagggtggctgatccatggaggtacccccttggtctggcctggtcccccaccttcattgtgggtttccccctccatgtgctgggtgacttcccacctgtccctgaaaccttagttggtggctccttcatgccggtcctgtcctctacacagagtaagcgtaaatttgagcgggactgccgggaggcagagaaggcagcccagacagctgagcggctggaccaagatatcaacgccaccaaggctgatgtggaaaaggtgcttgtgcggtctgaggcaggcttgggggggggggggggcagggcccgaacctggcagtgacccctgctttcatattcctcaggccaagcaacaagcccaccttcggagtcacatggcaaaagaaagcaaaaatgagtatgcggcccaactccagcgcttcaaccgagaccaggctcacttctatttttcccaaatgccccaaatattcgatgtgagtattcaaaacccacagccccacctcctccccaaattctaaaattaaccaactcctacacatttgttgaaaccccagctgcaatgccctaatctctaaattgaaagagaattagaaatgaagagtcacagtgcactctgccttttctcaagctattcgttctgcccgggttgtctttctttccttttaaaacttccatttattctttcaagccccatcaattaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgccttctttgaaatcacctccgttaactatacctgactcccatgagtgattctgccatgcacatgtccaatctctctctctccccacagtagataatcaattccaggagaacaagtatttgggcctgtatttctcactgctgcatcctccatccctagaatctgggcgggcatacagtaggtgctcaacaagtatttttgaatgagtgcatgaatgaacgaagaaatgaatgaatgattattggcttcagctttgcaactgaactcagctgagactcactcgaacgcctctcccacgaatgctgtctgtgaaaacagataggacctgattcccccacagacccctgcacctacctctacacatctgtcccgggccctggacactcgtctttcccctgctggattcaaatccgggcttgcagacacaagagtagctccccacactgtttcggcaaatcgcgtgctctgggcaagttttgggattggcacattcatttacatctagtgaatgggaatgaaaacccgggtcaaggcagaggaaacagtgaggacaggaagctgcgaacaggacattcatctcacccacaagggtaggagcgaagcattcgagggacggaacccccgttaccctcaattactgccttatctactgcttagctcctaatagaccctcaacaagaattcaaatccaagtttctctacttgatagttatctatccttatgcaagggactgtacctctctgggcctcaatttaatcatttctaaaatcaagatcatagacgctacccataagatcatcacatattacctgtacagatgaaacgacctttctttcccaagatccagttgtttccagtgggagatgagaaaccagtcaaacagctgcacctgtacctccctggcaggtcttgcagattgagtgaggaccacatactggggggctttgagaacactcatctatatctggacaggaaaagagagtcatagttgccaatatgctccttcatgtacaacagattgtatttttcaaagagcttgaaacactgtcttccatcccatgtgacctgcatgcaatgtcctttaactggtacactttccatcaagcagtgggtctatatttccttcccttgaatctgagtatggtggtggggacattaggtcatcaaaataccatggtaaatcatcaaaatatcatacacttccaccttgttctcttgagatgctcatgcttggctcagccgccatactgtgaggaagccttgcaagtcatgaaaaaccagctcacacggtaagattaagacttcccactcacagccctggagcagccaaccaatagccagcaccatcttgaagccacaggagtgagcccccttcaaagagaatcctctagcccccagttgagccaacacaactcacactgtggggaacagagttgagccattctcacccaactcagcccaaatagcagatttatttgtgagcaaaataaatgattgttgctgtcttaatgtaccaacaccaatagataaccagaacttttgcaaacccacttctaggaatttactcattggcgcacccatagaattgtgcagccattgtaccatggggtgggcctccccaaatctccttcagccctgctctgccaagtcatcctaagtaaacatttgctttgaagttgctggacaaatacaacttcaaggcaagcgccctatagctctcttccaggaaaatgcacctctccaagagagaaatctggacctgccacatgcatcaagataagatcacagggatattcttcccagttttaagtaatggaacattaaacatctaaatgtctgttgataataggatgattaaatcaggagttgacataaagaataatgtagcatgttccttcatttgagaaatatctattgaatattcacagtgtcttaggtaccatattgggagtcaaagacatgcagtggacaaggtccttaccatagtatccatcattttctagttggggcatgttgattctacctgtattttattttattttttgctttttatggccacacccacagcatatggaggttcccaggctaggggtcgaatcagagctacagctgctggcctacaccacagccacagcaacgccagatccaagccacgtctgtgacctacaccacagctcacggcaacactggatccttcacccactgagcaaggccagggatcaaacccacaaccacatggttcctagtcatataatttctgctgttccatgacaggaactcctgatcctacctgtattttaaaacgagggaccaaaaagactactgtgctcactgaataatccatgaacgatagcccaaaggtttaaaaaaggatgtttggagctccctaggaaatatagtaatagatattaaatcatcttattcagagattatcaaactacagcccaagtgtgaaatctggcccactacttgtttgtgtaaataaagttttattggaacacagccacatccattcatttatgcattatctctggatgcttttgcattacaactggagtgttgaataatcaagacctccatatcatatggcctgcaacctccaaaatgtttactatctggccccttgcagaaaaattttgcggatccctggtcttattcagaaacatagtcagatcttcactgttaaaaggaagtttgggtctaaatataaggaatacatatcaaaaactagctcattctgggtattattttagcttatattctttatgttaactgtagctcttggcactctacatgtgccaagcaggttgtatacattattgcatttaattttcccaactatcatttaaggtaaatacttctttctctctctctctctccctctcggccaccctgtgccatatggagttccttcgtcagatcccagccacagttgcaactcgcacagcagctgtgccacaccagatccttaacccactgtgctgggctggggactgaatttgcatcccagccctgcagagacgctgaagatccggttgcaccacagcagaacccctaaggtagatactcacatacacccattttatagatggaaatattgaggcttagagatattaatgatgtttctgcaacgctttacaactgctgtgtggcaaacaggtaatgtggtttggagaccgccattagagtcggaaagtcccgggtttgcattccaatttaactgcatgactctgaacacatcacttcagatatccaagcctcaggcttctcatctgtacaatggaggtcctagcaatgcctatgctcaatgtcatgtgaacaggcacataaagcccttcacacagggcctggcactccgtacaggttaggaattcatattattcacatggaaggaaatcaatgtctatttggggatattggcaaatagcatctttttcttttttttctaatgcaagtctctaatcgcaagaatttttgctggccaggtatcatttctcataatcaaaacgcgttgtcccgggctaaatgtctgcaccagactgnnnnaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagccgagagccgggtcctaagcaaccgaggggacaccctgggccggcacactcggcccccagaccccccagccagcgccccgccagacagcagcagcagcaacaacggatcacaggataacaaggagaggtgagcagggaggccagagtgtgtgtctgcatccaggcccaggagtgatggggaggggtcctgtcctcaccggctttgccctctccaaccagctctgaagagccccctgcagaggagggtcaggatgctcccatctacacggagtttgatgaggattttgaagaggagcccgcatcgcccataggccactgtgtggccatctaccactttgaaggtaaggacagcctgggtggcgcatcggtggcttcggggatagcatttttggctaggctctgtttaggttcaccttgagcagatctgagcccaccgccacccccaccccatgacagggtccagcgagggcaccatctccatggccgagggcgaggaccttagtctcatggaagaggacaaaggtgacggctggacccgggtcaggcggaaacagggaggtgagggctatgtgcccacctcctacctccgtgtcacgctcaactgaaccctgccagaggcgggaagagggggggctgttggctgctgcttctgggccacggggggccccaggacctacgcactttatttctgcccccgtggcttcggctgagacctgtgtaacctgctgccctcccccccaccctgccccggagcccccactcaagggacccactgtgccttccaccatcgatgtacatactcatgtttcccatcttttcttcctgccactcggctggggccgttttgttttatataaaacaattatgaaaagctcttacagtctgtgtcctattacgagattctgatactggggctggagattcaaacaccaccctcccgacaggtggcaccaggaaggaggaagggaaggcgaacttgggcacacgttggcatcccctgtcccttcctggggggttgggtgtgttgatagggaggagggtgccagatgtcacccctttggtgttctgctatagctcactgagaacaggtcacacctgttgagcccctactgtgtgccaggcattttccacccatgatctcattcaaacgctgagctttaatccccatgacaacccctggaaagtacacagtctcacttttatgttgaaggcggggatagagagagaggtcaagtgatctgctggaagtcacacagcatttaaaatggatttaaactctggcctcttacagatctgcgagttctctttaacattcaaagcctcacattcaccacttgtgggatatgttgaggggggtgtgggcatggggtggtgagaaagggcgttcagaacctccagatgtcgggtcttctcatatggggaagtaggctgccctcccttaggattcgtgctcagttttagggtgcagggtgcgttcttgcaaaccaggacccgtcccttctgtgaggctgggtgcaggtcccactgcatttggctgcctgaggacactggggatccctggaagactgggtatcgccgcgtgaagaagtggatctgtgctttcaaaggtcaggctccaggcgctgcgacaggacactgaggacgtgctggaacttgtcgaaacgtgtgacccacggtgccccagcccctctgcttccccagagcagcctccgcaagaaaccggtggtcagggcctctttcagctcagggttgggctggaatcctgggggcggagccaggttagctggaggcgtggccaggcacctgccttaccctctgataactgcctggtccccttgggactttgacccagcaggggccaggagggattctgtcccaggttatctgaactgctgggcaaggttagcggggagggggctcctgggtctctgcagggagtggggtgggggtggctaacgggcccagtggaagcgggctctgccaggagtgcatgggagcagtctgctccaggtgcaagacctggtggccccaccttagggcttgtgcctggagatggagctgccccggggggcgggacttggggtccaggctaccctacgcgacaaacgcccagggggtgggggtggagttgggcctagttggagggagaagagtgctaagtgaaggcaggaactacccaggtgggagattctggaagctgggctgccccagagaggtgtggctctgagctcagagggagagcagtaccatcaggttgaaggactgaatcattttggggggatcgagatcctctgggggcaggaccttcccaagtgtgagagagtgggactctgcgggcgtggctctggggggatagggccgccctttaggggcggacggcaccatctggtctattgcagcatgcttgagtcgagaaacacccacccagggcggggccgtctcaatttgggtggggccctcagtttgggaggtgtagcgggaggctctagtccctgggccggtgggtttgggggtgccgggctacagcatacggcgtgttcttaaagtcaggatcctctggcagccgggcgcagatggggcgctcacctcgcaggcgccgggctgtcgcctcgcggaatctgggcgcgtcccgggccgtctgacgcgcccggtccagggtgcgcagcagccgctcgcagctctcgtccaagggccccgggacttcctcgccctccagcaggcgcaccacgggtgccacgtgcggcagcgccacctcgcccgggtcgcaaggtcctgttggggtaagggtctgggctgggctaggggcagagggtgggtcctagggtgaagagggtgcgccatacattgggccgaaacaccctaggacaaaagcaaggggtggagtttgggtcagatacgaagtcttgagcaggaccgagtcaggggaggggcccagggaaggggcggagcctaggagatagtgagggcggggcctagggatctggtcctggacctagcttcgcacagagggcgggggctagggcgagggggcggggccttggacccaaacagccagctgaatgtagggcggaggtggagcaaaggacagaaacaaggggtggattttggttggaaagagacccagaggccagagagcctagcaaagagctggatgggagacagggaccaggcctaaggcgcggagtggggtactaaaacccccgcggggcttagaaccggattgaggtcctgattagagttaccacttatctaaagatgccactcaccggtgccctcatccagcgtccgcattagaggcttcagctcctgctcgaaggccagcgcagcctccgtgtggctcctccggagctggcgccacgtgcgttccaaccgcgacacctggaagaagagacccgagcccgccttctctccactcttccccttcacttgctctctggcctcgtcccgcatccctgcttcctacgcacctggggcatgagcaaggcgcccatgaccgcagccagtccaggcaggtcccccgccgcccctggccgcagcgccagagccagctccaccaggcccttcagggcggcggcgcgctcctccagcggtcccgcgcagcccagcactgccagcgcccccgccaacgccagcgtctcgagcctgcagaggcggagggcaaggttttggaggcagtggcggggtttgcgatgtgggggtgaggagggagagcaggtgacacagctcatctcccctcctccctggggggccgtgaatgggggggaggttgaggaccctagggattttaggtggctgccttacctctccagcagttccaacctcaggcgatgtccatggggaagagtgagcagctccagaccagaggcaacccccatggcgccccgctgagccttggtcacccccaggaggcctgtctcctggcagtgggggaggggtaagagtagggagttcagaggagcagaatgagtaaatgggtatgaggtgagactgggccatgccctggcttcagccctacctggtaggggacccacctggcagtccaccaatagcaggtggagggcagtgctcccaggatggtgctccaggaacaggccacggagaatgcgcagggctttaggttccagaggccgattctgggggcccagcaggcaggaggggttgtcagggggacagaaagagacctcaccctgtggtcttgcaaaacatctttgctcctcctcctcttcctcttcattggcctcccaccatggtgcctctggctctgggcagctgtggccagggggtgttccatggaccctaggcactcggggcaccagctcacagtacgttggggagcgtccagaggcatcaggcagcatcagtgaaggtgttcgaggtggcttggttggtgccttggcatgaagctgcccatcggaggccctcaggttgtcagcaatggaccccaggagagctggggtctttagcaacacagggtcacttcctgtccgaggcaatgcagatgcgggcacagtggaggctcctgggggtcacacaagagagggtaaaagaggtccacagagaaaatagctggttggggctttgtggggtaccaacctccaggttcattcactcgttcagccaataaccaggtaccccacctaacctggcgcagctttggacttgaacgacttcaccaaaactcctctagcccatatggagttttgcaaattctgaatgctaaattttaaatttgaattctttgttcttgcccctcggttcctgcattgctatagctgtggcataagccagcagctacagctctgattcagcccctagcctcggaacctccatatgccgtgggtgtggccctaaaaagcaaaaataaataaataaatactcccgtctccatactccttactctgttctactttagtttttgccccaaagcatacataattgactaatttttgttgttcatggtccttcttcctctaaaaggatgttggctccaccagcgcagggatctgtgtcattcttgttcattgatgttatcacagcacttcatacagtctcaggcatgtcacgagactttgggtggagggcagggctgacaaggcagtcaggacacaaaggggactcttcctttatgtaggattatcagggtcggctgctctgatgaactcatgttagatgagaaggagtcagtcaggtaaaggtagggaatgagctttttccagtggtgagaatagcaagtgcaaaggccctgaggccggaacatattcggcaggttccagcaactgtaaaaaagactgtgtgattgacgtgaagaggggatgtagcaggagttattaggtcagccatggttagagcatatagggctccttggaataataacaaacccacattttattttcttcttcttatttttggccacacccacagcatgcagaagttctggggccagggatggaacctgtgccacagcagagacctgagccgcagcagtgacaatgccagatccttaacttgagccaatagggaactctggaactccataaacacatatttttttttaaatttttttacaaagttcctgtgtgtttttaaattactgtgacaacatgaagagtattaccatcccttttttccaaaaggttaagtcccctgcccaaggttccttaggtatagcctggcagagccgtccctgagctctgtgctgcctgggaagccccttacctggtccagggtggtcttctgttgggtgccccacatgctcc

SEQ ID NO: 27 - DNA, 5127 bp, Sus scrofa
ctcacttccccccccacccccgtcctttccctctgtccctttgtccctccaccgtccctccatcatggggtccacctcgggtcccaggctgctgctgctgctcctgaccagcctccccctagccctgggggatcccatttacaccataatcacccccaacgtcctgcgtctggagagtgaggagatggtggtgttggaggcccacgaagggcaaggggatattcgggtttcggtcaccgtccatgacttcccggccaagagacaggtgctgtccagcgagaccacgacgctgaacaacgccaacaactacctgagcaccgtcaacatcaagatcccggccagcaaggagttcaaatcagagaaggggcacaagttcgtgaccgttcaggcgctctttgggaacgtccaggtggagaaggtggtgctggtcagccttcagagcgggtacctcttcatccagacggacaagactatctacaccccaggctccacggtcctctatcggatcttcaccgttgaccacaagctgctgcccgtgggccagaccattgtcgtcaccattgagacacctgaaggcattgacatcaaacgggactccctgtcatcccacaaccagtttggcatcttggctttgtcttggaacatcccagagctggtcaacatggggcagtggaagatccgagcccactatgaggatgctccccagcaagtcttctctgctgagtttgaggtgaaggaatatgtgctgcccagttttgaggtccaagtggagccttcagagaaattctactacatcgatgacccaaatggcctaactgtcaacatcattgccaggttcttgtacggggagagtgtggatggaacagctttcgtcatctttggggtccaggacggtgaccagaggatttcattgtctcagtccctcacccgtgttccgatcattgatgggacgggggaagccacgctgagccaaggggtcttgctgaatggagtacattattccagtgtcaatgacttggtgggaaaatccatatatgtatctgtcactgtcattctgaactcaggcagcgacatggtggaggcagagcgcaccgggatccccatcgtgacctccccctatcagatccacttcaccaagacccccaagttcttcaaacccgccatgcccttcgacctcatggtgtatgtgacgaaccccgacggctcccctgcccgccacatcccggtggtgactgaggacttcaaagtgaggtccttaacccaggaggacggtgttgccaaactgagcatcaacacacccgacaaccggaattccctgcccatcaccgtacgcactgagaaggacggtatcccagctgcacggcaagcgtccaagaccatgcacgtcctaccctacaacacccagggtaactccaagaactacctccacctctcgttgccccgcgtggagctcaagccaggggagaatctcaatgttaacttccacctgcgcacggaccccggctaccaagacaagatccgatactttacctacctgatcatgaacaagggcaagctgttgaaggtgggacgccagccgcgcgagtctggccaggtcgtggtggtgctgcccttgaccatcacgacggacttcatcccttccttccgcctggtggcttattacaccctgattgctgccaatggccagagggaggtggtggccgattccgtatgggtggatgtcaaggactcatgtgtgggcacgctggtggtaaaaggtggcgggaagcaagacaagcagcatcggcctgggcaacagatgaccctggagatccagggtgagcgaggggcccgagtggggctggtggccgtggacaagggcgtgtttgtgctgaataagaaaaacaaattgacccagcgtaggatctgggatgtcgtggagaaggcagacattggttgcacaccaggcagtggaaaggactttgccggcgtcttcacagatgcagggctggccttcaagagcagcaagggcctacagactccccagagggcagatcttgagtgtccgaaaccagccgcccgcaaacgccgttccgtgcagctcatggagaaaaggatggacaaactgggtcagtacagcaaggacgtgcgcagatgctgtgagcatggcatgcgggacaaccccatgaagttctcgtgccagcgccgggctcagttcatccagcatggtgatgcctgcgtgaaggccttcctggactgctgcgaatacatcgcaaagttgcggcagcagcacagccgaaacaagcccctggggctggccaggagtgacctggatgaagaaataatcccagaggaagacatcatttccagaagccagttccccgagagctggctgtggaccattgaggagtttaaagaaccagacaaaaatggaatctccaccaagaccatgaatgtgtttttaaaagactccatcaccacttgggagattctggctgtgagcttgtcggacaagaaagggatctgcgtggctgacccctatgaggttgtggtgaagcaagatttcttcatcgatctgcgtctcccctactccgttgtgcgcaatgagcaggtggagatccgagctatcctctataactacagggaggcagaggatctcaaggtcagggtggaactgctctacaatccagctttctgcagcctggccaccgccaagaagcgccaccaacagactctaacggtcccagccaagtcctcagtgcccgtgccttacatcattgtgcccttgaagactggcctccaggaggtggaggtcaaggccgccgtctacaaccacttcatcagtgatggtgtcaagaagaccctgaaggtcgtgccagaaggaatgagagtcaacaaaactgtggtcactcgcacactggatccagaacataagggccaacagggagtgcaacgagaggaaatcccacctgcggatctcagcgaccaagtcccagacacggagtcagagaccaagatcctcctgcaagggaccccggtggcccagatggtagaggatgccatcgacggggaccggctgaagcacctcatccaaaccccctccggctgtggggagcagaacatgatcggcatgacgcccacagtcatcgctgtgcactacctggacagcaccgaacaatgggagaagttcggcctggagaagaggcaggaagccttggagctcatcaagaaggggtacacccagcaactggccttcagacaaaagaactcagcctttgccgccttccaggaccggctgtccagcaccctgctgacagcctatgtggtcaaggtcttcgctatggcagccaacctcatcgccatcgactcccaggtcctctgtggggccgtcaaatggctgatcctggagaagcagaagcctgatggagtcttcgaggagaatgggcccgtgatacaccaagaaatgattggtggcttcaagaacactgaggagaaagacgtgtccctgacagcctttgttctcatcgcgctgcaggaggctaaagacatctgtgaaccacaggtcaatagcctgttgcgcagcatcaataaggcaagagacttcctcgcagactactacctagaattaaaaagaccatatactgtggccattgctggttatgccctggctctatctgacaagctggatgagcccttcctcaacaaacttctgagcacagccaaagaaaggaaccgctgggaggaacctggccagaagctccacaatgtggaggccacatcctacgccctcttggctctgctggtagtcaaagactttgactctgtccctcctattgtgcgctggctcaatgagcagagatactacggaggtggctatggatctacccaggccactttcatggtgttccaagccttggcccaataccagaaggatgtccctgatcacaaggatctgaacctggatgtgtccatccacctgcccagccgcagcgctccagtcaggcatcgtatcctctgggaatctgctagccttctgcggtcagaagagacaaaagaaaatgagggattcacattaatagctgaagggaaagggcaaggcaccttgtcggtggtgaccatgtaccacggcaaggccaaaggcaaaaccacctgcaagaagtttgacctcaaggtttccatacatccagcccctgaaccagtgaagaagcctcaggaagccaagagctccatggtccttgacatctgtaccaggtaccttggaaaccaggatgccactatgtcaatcctggatatatccatgatgactggcttctctcctgatactgaagacctcaaactgctgagcactggtgtggacagatacatctctaagtatgagctgaacaaagccctctccaacaaaaacaccctcatcatctacctggacaagatctcacacaccctggaggactgtatatccttcaaagttcaccagtactttaatgtggggcttatacagcctgggtcagtcaaggtgtactcctattacaacctggatgagtcttgcacccggttctaccaccccgagaaggaggacgggatgctaaacaaactctgccacaaagaaatgtgtcgctgtgctgaggagaactgcttcatgcaccatgacgaagaggaggtcaccctggacgaccggctggaaagggcctgcgagcccggcgtggactatgtgtacaagaccagacttctcaagaaggagctgtcagatgactttgacgattacatcatggtcatcgagcagatcatcaaatcaggctccgatgaagtgcaggttggacaggagcgcaggttcatcagccacatcaaatgcagagaagccctcaaactaaaggaggggggacactaccttgtgtggggagtctcctccgacctgtggggagagaaacccaacatcagctacatcattgggaaggacacctgggtggagctgtggcctgatggtgatgtatgccaagatgaggagaaccagaaacagtgccaggacctggccaacttctctgagaacatggtcgtctttggttgccccaactgatgccactcccccacagtctacccaataaagctccagttatctttcacatttaaaaaaaaaaaaaaaaaaaaaaaaaa

SEQ ID NO: 28 - protein, 1661 aa, Sus scrofa
MGSTSGPRLLLLLLTSLPLALGDPIYTIITPNVLRLESEEMVVLEAHEGQGDIRVSVTVHDFPAKRQVLSSETTTLNNANNYLSTVNIKIPASKEFKSEKGHKFVTVQALFGNVQVEKVVLVSLQSGYLFIQTDKTIYTPGSTVLYRIFTVDHKLLPVGQTIVVTIETPEGIDIKRDSLSSHNQFGILALSWNIPELVNMGQWKIRAHYEDAPQQVFSAEFEVKEYVLPSFEVQVEPSEKFYYIDDPNGLTVNIIARFLYGESVDGTAFVIFGVQDGDQRISLSQSLTRVPIIDGTGEATLSQGVLLNGVHYSSVNDLVGKSIYVSVTVILNSGSDMVEAERTGIPIVTSPYQIHFTKTPKFFKPAMPFDLMVYVTNPDGSPARHIPVVTEDFKVRSLTQEDGVAKLSINTPDNRNSLPITVRTEKDGIPAARQASKTMHVLPYNTQGNSKNYLHLSLPRVELKPGENLNVNFHLRTDPGYQDKIRYFTYLIMNKGKLLKVGRQPRESGQVVVVLPLTITTDFIPSFRLVAYYTLIAANGQREVVADSVWVDVKDSCVGTLVVKGGGKQDKQHRPGQQMTLEIQGERGARVGLVAVDKGVFVLNKKNKLTQRRIWDVVEKADIGCTPGSGKDFAGVFTDAGLAFKSSKGLQTPQRADLECPKPAARKRRSVQLMEKRMDKLGQYSKDVRRCCEHGMRDNPMKFSCQRRAQFIQHGDACVKAFLDCCEYIAKLRQQHSRNKPLGLARSDLDEEIIPEEDIISRSQFPESWLWTIEEFKEPDKNGISTKTMNVFLKDSITTWEILAVSLSDKKGICVADPYEVVVKQDFFIDLRLPYSVVRNEQVEIRAILYNYREAEDLKVRVELLYNPAFCSLATAKKRHQQTLTVPAKSSVPVPYIIVPLKTGLQEVEVKAAVYNHFISDGVKKTLKVVPEGMRVNKTVVTRTLDPEHKGQQGVQREEIPPADLSDQVPDTESETKILLQGTPVAQMVEDAIDGDRLKHLIQTPSGCGEQNMIGMTPTVIAVHYLDSTEQWEKFGLEKRQEALELIKKGYTQQLAFRQKNSAFAAFQDRLSSTLLTAYVVKVFAMAANLIAIDSQVLCGAVKWLILEKQKPDGVFEENGPVIHQEMIGGFKNTEEKDVSLTAFVLIALQEAKDICEPQVNSLLRSINKARDFLADYYLELKRPYTVAIAGYALALSDKLDEPFLNKLLSTAKERNRWEEPGQKLHNVEATSYALLALLVVKDFDSVPPIVRWLNEQRYYGGGYGSTQATFMVFQALAQYQKDVPDHKDLNLDVSIHLPSRSAPVRHRILWESASLLRSEETKENEGFTLIAEGKGQGTLSVVTMYHGKAKGKTTCKKFDLKVSIHPAPEPVKKPQEAKSSMVLDICTRYLGNQDATMSILDISMMTGFSPDTEDLKLLSTGVDRYISKYELNKALSNKNTLIIYLDKISHTLEDCISFKVHQYFNVGLIQPGSVKVYSYYNLDESCTRFYHPEKEDGMLNKLCHKEMCRCAEENCFMHHDEEEVTLDDRLERACEPGVDYVYKTRLLKKELSDDFDDYIMVIEQIIKSGSDEVQVGQERRFISHIKCREALKLKEGGHYLVWGVSSDLWGEKPNISYIIGKDTWVELWPDGDVCQDEENQKQCQDLANFSENMVVFGCPN

SEQ ID NO: 29 - DNA, 15532 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcacgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcgtgagtgcatggggtataaggcaagtgctgagggagaaaacgtagttgatggggtagagcagacggggttggaggtggggtggagggggagggctttggacagaagacctgggaggcttggtgggggaggggcgcccaggcctgggcactaagaaacaagtcccctggagctcaagaccatctcggcctcccctagcccaagagaggactggcttcatgactccctgaaaccatttctaaatgccttagaacaaaccttgcatattcattattgttattgaactattaaaagtcttttttgggggcgagctgaatcagatcctttgctggagctggcacacggaggaagtcctggagggagggtagacaccgtggaggtaagggcttgggacctgtgtcaggagagctaggtccatctccctcccagtctctcactaggcttatgatctttagcagtgaaaataatctctctaaggtggggaaaggaccccggtccctgctgtgctcaataaattatgaggatcaaaataaattatcagtgaatgtgaatgggaaaactaagaaattgttaaaattctcgaatacattacattttcatccacagaaaagtgtaggctagggatcatgggggaatagttagtaatgacagggatagttgaacttaaaaaaaaagtttgtgaggctgacaaagaagaaacggacacatttcctgatcttggagggttcatagggtagaagatggtagatgacagctgggtgtggtggcactcgcctgtagtcccagctactcaagaggctgtggtgggaggattgcttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaagggaggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagacccccaaggggaaccctgatgctaatggcagttgggccttaggcagggcgcagggcagcgcagatgccccctcccctccagtgcagatgcctgctctggaccctgcctcatggtggccccttccccactccttcatcctcagcctcaccctcttgaggaccccaccctccagcccacaggtgctggaccatccctccctggtccctccgcccctctccaccttgggaccttgtgctgctcctgtctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccaccccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccgatttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccataacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttcctgatggggtccccagttaggagctgcctgctcagggctgggaggggaggagcactgagctgcagatagagggcagagcccacagtgggcagggcctgccctggtgtgtaggtgcctctgaaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagagaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 30 - DNA, 1410 bp, Homo sapiens
aagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatattaaaaaaaaaaaaaaaaaa

SEQ ID NO: 31 - protein, 383 aa, Homo sapiens
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 32 - DNA, 16848 bp, Homo sapiens
ctgtttccagcgagtcagattccagatcgcgctccagcctggactcggaattcctgccccgcgggtctgcattttcacagcggcaggtgtgagtgccgcgcagctggagaccagaagcctgaggcagctcggccctccccagcccaaagtgccgttattccgtttctgtatcagtaaacacgtttcattttccgtagaccagggaagggtgatgggtgatcccagtcctcgcagtgaattccgggccacaaaattcaaaacgcttgcgggcaaagccgtgcgcggtggctcaagcctgtaattccagcactttgggaggccgaggcgggcggatcacctgaggtcgggatttccagaccagcctgaccaacatagagaaaccccgcctctactaaaaatacaaaattagccgggggtggcgcatgcctgtaatcccagctagtcgggaggctgaggcaggagactcacttgaacccgggaggcggaggttgctgtgagccgagatcgcgccactgcactccagcctgggcaacaagagcgaaactccgtttcaaaaaaaaacaaaaaacaaaaagctttcgggcgccgagggcagccccgccctgaattttgtgagcgaccgcgctgggccgtttctctttcttttccggaccctgcagtggcgcctaaagtctgcgaggaggaagtcgcctctgtgctcgtgagtccagggatctaaggcaagtgctgagggagaaaacatagttgatggggcagagcagagggggctggaggtggggtggagggggagggctttgaacagaagacctgggaggcttggtgggggaggggacccaggcctcggcgctgagaagcaactcccctggagctcaagaccttcttggcctcccctagcccaggggaggactggcttcatgtctccctgaaaccgcttctaaatgccttagaacaaaccttaaatattcattattattattgaactattaaaagtcttttttggaggcgagctgaatgagaccctttgctggagctggcacacggaggaagtcctggagggagggtagacaccgtggagggaagggcttgggacctgtgtcaggagagctgggtccatctgcctctctgtctcaaactatgcttatgatctttagcagtgaaaataatctctctaaggtggggacaggaccccagtccctgctgtgcttaataaattatgaggatcaaaataaattatcagtgaatgtgtatgggaagactaagaaattgttaaaattctcgaatacattacattttcatccacagaaaagtgtaggctagggatgataggggaatagttagtaatgacagggatagttgaacttaaaaaaaaaggttgtgaggccaacaaaaaagaaatggacacagttcctgatcctggagggttcatagtctaatgggggaggagggtagaagatggtaggtgatggctgggtgtgtggcactcgcctgtagtcccagctactcaagaggctgtggtgggaggattgcttgagcccaggcatttgaggctgcagtgagctataatcacaccactgcattccaactgagtgacacagcaagactcctctcttaaaaaaataaaataaagtaaatgaaaaaaataagattcaagacagggcacagtcggtaccatcaggaaggttcaaaccatgggctagatcagtagttctaaaacttgactacacatcggaatcacgtagggaactttaaaagatactaaggtttaggtccaacctaggtttactgatttaactggttgtggctgtggcctgggaacatggatattaaaaactctccaggtggttctacgcagtggctaggtttgaagaccactgcctagatgtcccaatgactaagaatgtgcgctggggacaagccaattctcttagtagaggctttccagacagaattcttattattgagaattgagaattcacatgccacacataatttatcgttttaaagtgtacagatcagtggcttctagcataatcacaaggttgtgccaccgtcaccactatctacttgggaagattttcttcctttttttcttttttttttttttttttgaggcggagccttgctctgttgcccaggctggagtgcagtggcgcaatctcagctcactgcaagctccgcctcccgggttgaccccattctcctgcctcagccttctgagcagctgggactacaggtacccgccaccacgcccagctaagttttttgtatttttagtagagacggggtttcactgtgttagcaggatgctctcgatctcctgacctcgtgatctgcccacctcgacctcccaaagtgctgggattacaggcgtgagccaccgtgcccggaccctttttcctttttttttttttttaaaggctagtcaagtgaaacagtgggagtgaagatgaaacaaaaacatctataactggttgtgatcaattagttgtaaacaccactgcactcagaccagcctaactgggaagattttgaggatatgctgtggtctgatgggttccaaggcagaggtgacagtaacctggaagagggagactgcttaggcagtggcatcctggtgggatagggtgaggagatcccagagcccacgtttactgcaaccctggggaaatgtcaccagagaaatgggggtggtgccagacaatagattgtgggagctatggtttccatggtagagtagaagcatccaccatgtgtgacattcagcagatggggcgctgtgggtggcttggagcactctggttgtaactgaggcaggcacagtgtttaggaagcctgtgcagtaatccagactgaagggaggggaaagcctagactaagactatggctgtgggattgaaatagcgttgaaggagctgactttgactcccggagatgaaggagaaagaggaaatcagaagggaccaaggatggtgaagttcttaagagaaactgaggaggaagagaggatgatgtggtgggagacgtgtagagagtccttgtagatctgtcatattgaaggggactatggtcccagaggtacagatgtcctaaaacaggctggaaaagggagtctggagagagcttggtgttgtaatgaaccatggggagccgcctcgttggccctgtgattacccaggaactgaatagagagggggccctgggagacctcagacacttagaggatataagggggtgaaaggggggacctggctttgagtcgaagggaggagaaggagattatatagctgaaacgtctaagagaatttgtgatctgagcgtttctactggggcaagtgcttctgaaaggcagaggcggctgagatctggaaacaggtctgcaaatctggtcactggtctcattgcagtaacgctgtgcgcggttgagggagtgtattgggagaaaaaccacgcgttgtctgtcccggaaggaacaagccagtgagagccggcctgatgggaggaccggcgaaaggggcttggtgaagcccgcgctccttgggggtgggaatgcggggatggggtggtcgcgatgcagggagggcgacagggtccaggtcgtgctcataagtttggagctgtactctcagctactcggggctggtccttgattttggctgcgctcgcgcacgctcccccttttctggccgccaggtcccgccttctaaatttccccaggtctccaggccgctagaattttctcttctgaacgtggccccgccctctccactcatgattggccctaagttccgggcctcagttttcactggataagcggtcgctgagcggggcgcaggtgactaaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctggtgagtggggttcctggcggtccccggcggagcgggagcggcggggcgtttccgggggtccgggtgggttgccgcgagcgctgtgcggtcagggcggggctcaggtgtgctgtctggagtgcagggagctggacgccgcctgttcccgccacacctcagccctgctttcccatctcccgtctctttttttttttttttttttttttttttttttttttttctttctgagacggagtctctgtcgcctaggctgtagtgcagtggcgcgatcttggctcactgcaagcgccgcctcccgggttcacgccattctcctgcctcagcctccctagtagctgggactacaggcgcccgccaccacgcccggctaattttttgtgtttttagtagagatggggtttcaccgtgttagtcaggatggtctcgatctcctgacctcgtgatccgcccgcctcggcctcccaaagtgctgggattacaggcgtgagccaccgcgcccgacctcctgtctcctttcagtcctcctcgggatcgcgcatcacccgcattttctggtctctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatccatttctagggtgtcctctgccttcatcccccgcccccgccactgaaggtccctcctgcctcctttatgggcctttcctgcaagcagccttcactccgtgctgcccctatgcctccccattcccaaatgtccctgactctaactttctggtgctgccttttgtccgggggggtcttccctccatcccactcccctccagacccccaaggagagccctgatgctaatggcagttgggccttaggcagggcgcagggcagcgcagatgccccctcccctccagtgcaggtgcctgctctgggccctgcctcattgtggccccttccccactccttcatcctcagcctcaccctcttgaggaccccaccctccagcccacaggtgctggaccatccctccctggtccctccgcccctctccaccttgggaccttgtgctgctcctatctcttgcccagctgcctggggccctcagcaagttctcatctttcagtgggaaagtgggagtgctggagcatatgacagtgctgagaatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccagctgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccaccccttgctttgtttttaatttttaacttttgtttgggtacgtagtagatatgtatgtatatatttatggggtacatgggatattttgacacaggcctacaatatgtcataatcacatcagggtaaatgggttatctatcacaacaagcatttatcctttctttgtgctacaaacaatcccattatgctctttcagttatttttaaatgtacaataaattattgttggctgtactcaccctgctgtgctatctactagatcttattcattctaactatatttttgtacccattaaccatccgcactcccccactccccactacccttctcagcctctggtagtcgtcattctattgtctctccccatgaggtccattgttttaatttttggctgccacaaataagtgagaacatgcgaagtttgtctctctgggcctggggcttatttcacttcacatgatgacctccagttctttgcaaatgacatgatggctgaatagtactccacatacacgtgtgcaccacattttctttctccattcgtctgttgatggacacttaggtcgcttgcagatcttggctattttgaatagtgctgcaataaacatggaaaagtagatagctctttaatataccgatttcctttcttttgggtatatgcctaacagtgggagtgctggagcatatgacagctctattatatttttagtttttggaagaacctccacattatttcccacagtggttatactagtttacgttcccaccaacagtgtacaagggttctcttttgctacatcctcgccaggattccttattgcctgtcttctggataaaagccagtttatctggggtgggatgatatctcgtaggagttttgatttgccttcatctgatgacgaatgatgttgagcaccttttgatatacctgtttgccatttgtatgtcttcttttgagaaatgactattcagatcttttgctcatttttaagttggattattagatatttttcctatagagttgtttgagatccttatatgttttggttactaatcctttgtcagatgaatagtttgaaaatattttctcccattcttggatggtctcttcactttgtttattgtttcctttgctgtgcagaagctttttaacttgatatgatcccatttatgcatttttactttggttgcctctgcttgtggggtattacttaaaaaatctttgccagtccaatatcttagagagtttccccaatgttttctttcatagttttcatagtttgaggtcatagatttacatctttaatcctttttgattggatttttatatgtggtgagagatagggtccagtttcattcttctgcataaggatatctagtttccccagcaccatttattgaagagactctcctttgccctgtatgtgttcttggtaactttgttagaaataacttcactgtagatatatggatttgtttctgggttctctattctgtttcattggtccgtgtgtctgtttttatgccactaccgtgctgttttgattactctagctctgtagtataatttgaagtcagataatgtgattccgctagttttgttctttttgctcagggtagctttatctattctgggttttttgtgattccatatacattttaggattgtttttctatttctgtgaagaatgtcattggtgttttgatagcaattgcattgaatttgtagattgctttgggtaggatggatattttaacaaaattgattcttccggctgggcacggtggctcactcctgtaatcccagcactttgggaggccgagtcaggtggatcacttgagatcaggagttcaagaccagcctgatcaacatggggaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccgtgaacatggaatgccttttccattttttgtgtcctcttcaatgttttgcatcagtgctttatagtttttattggagagatctttcacttcttcagttaagtctattcctaggtattttattttatttgtagctaatgaaaatgggattcgtttcttgatttctttttcagattatttgctgttagcacatagaagtgctattgttttttgcatgttgattttgtatcctgcaactttactgaatttgttcttcagttctaatagttttttggtggagtctttaggttttccaaatatcagaccacatgatgtgcaaacaaggataatttgacttcttcttttccaattttgatgccctttatttccttctcctgtcagattgctctagctaggacttgcagtattgtgttgcataactgtagtgaaagtagtcatccttgtcttgttccagatcttaaagaaaaggctttcagttttcccccattcagtatgttactagctgtgagttgtcatatatggcttttgttatattgaggtctgttccttgtatactcagtttttttagagtttttatcatgaagggatgttaaacttatcaaatgctttttcagtatcaattgaaatggtgatatggcttttgtcctttattctgttgatacgatgtattacattgattgatttgtgtatgcatacctggaatacattccacttggtcatgaagaatgatctttttaatatactgttgaatgtggtttgctagtatttcattgatgatatttgcctcaatgttcatcagggatataggcctgtagttttctttttttgatgtgtctttgcctgattttgatatcaggatattcctggctttgtaaaatgagtttggaagtattccctcctcctctgtttttcagaacaatttgaataggactgatatttcttgttctttaaacgtttaattgtggtaaattatacattacatacattttactgttttaaccgcttttaagtgtatactcggtggcattagatacattcacatttttgtgcaacccaaaactctgtacccattaatcagtaactccccattcctccctacctctggcccctggtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacatcttggttatccattcctcagacaatggacacttgggttacttctaccttttggatattggcaaatatttcatttctcttgggtatatatttatttcttttgagtatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtgtgtgtgtgtgtgtgtgtgtgtgtgtgtgtgtgtgataatagccaccctgattggtttgaagtggtatctcattgtggtttggatttgcattttcctaatgagtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttctttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgattcattttgagttaatttttgtatatagtacaaattaagggtccaattttatattatttgaacatccagttcccccagcactatttgctgaaaagatggacttactctttgagaccctgtcacctgcccaccccagtggacactagctggtccatccaattgctgtcctggggccttgtcatgctactcttccactttggacccaagcccacatcattgctcccctctgggatactgaccccactataaacttcactggggctacaaccttcctaccccttgtgcctcatgaccaccccctcccttgtccccaccatgcccatgatgagtcttttctcaaggcagctcgccttgcctccatctcaccctcacctgtgcaccacagccacactggacatgggtccctctgagcctgagtcccttcccattcccactgtcccctctggcaagaccttccttccaacactgccttcatgctcctcccttgcccctgcagggcagcctctccccttggcccctattcccttagggggcttgtggccacccagtcctggcacctgacctacaagtttgccatcttcattcccccttcttctgttcatcagccccctcctctatcctcccaccctcacagttttccttgtatatgaaatcttcgttcttgtccttttgcccatgcgcatttcctgcctcctcagggaggtcgggacagcagacctgtgtgttaaacatcaatgtgaagttatttccaggaagaagtttcacctgtgatttcctcttccccagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggtgagagtcggcaggggcaagagtaatgggaggccttctccaggaaagttggagacagagagcagggacctgtctcttcccgctggatctggctgggggtggggatgaggaatagggtcagggaggctcagcagggtggtgagccggaactcagcccacacagggaggcatggaggagggccagggaggggtcgctgctgggctgagttcctcacttgggtggaaaggtgatgggttcgggaatggagaagtcactgctgggtgggggcaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacaggtaccgaccctggccaggggctctactgttcccgcaattctgctagagttgcctcgcctcccagctctgtccggggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggtgtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccggtatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctggtgagcctggggtgaccctggagagggtcaggccagggtaggaacagcaaggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctgggacaggggatggaagctggggtatttgggaggggaatgggagctgcatctccatctacacccataagtgcttcccaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcgatgcccacccgtgtgcctcctccaggaggcactttccaggttcccactacctggcctccctgagtttccttgcagatgacacagatgaatagataagcagatgtccctgggccatttgaggagcggggcccagcccctcatcagggcagatgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacagtcagaagcatttcccccacagtcaggttgtttgatgggagatgaaaagagacagcagaagttttgtgtttctgcaaaaacagaggcagtgcaggggacagtgagaggctggggtgtccaggagacctgagtctggcggtaggggcgctggtttctcatccttgaacctagttgcactgtcagtcggcccctcatgcctgagcagatgggaaggttcgtcccctgccctgcagcaagagggccccatccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttctcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcacagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcaggtcaggtgcagatcctgtggcagccacgtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagagaagggcctggggactgagagcaagggtcagggcctctctttggggaggcctctcactgtaacaggactggtcaggcctgagaggagggcactgggttccctcttgggtcttgtccttttgtcttggggccctttcactccctgcacggtgagtggtgggcacaggacaggggctgatgttgatggagtgatgggagagaactgacaggggctgggaaaagcaaggagggaggaagaaaaaagtgggggcctcatcttctctcagagaaagggcgaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 33 - DNA, 2426 bp, Homo sapiens
gaattttgtgagcgaccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagaaaaaaaaaaaaaaa

SEQ ID NO: 34 - protein, 351 aa, Homo sapiens
MVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 35 - DNA, 20 bp, Artificial Sequence
  Description of Artificial Sequence: Synthetic primer
cgcctagagaagaggctgtg

SEQ ID NO: 36 - DNA, 20 bp, Artificial Sequence
  Description of Artificial Sequence: Synthetic primer
ctgctgtggctgtggtgtag

SEQ ID NO: 37 - DNA, 1341 bp, Sus scrofa
ggaactcggagaggtctccgctaggctggtgtcgggttacctgctcatcttcccgaaaatgatggcgttttgcgcgctgcgcaaggcacttccctgccgtcccgagaatcccttttcttcgaggtgcttcgttgagattctttgggtgtcgttggccctagtgttcctgcttcccatgccctcagatgcctgtgatgagccaccgaagtttgaaagcatgcggccccaatttttgaataccacttacagacctggagaccgtgtagagtatgaatgtcgccccgggttccagcccatggttcctgcgcttcccaccttttccgtctgtcaggacgataatacgtggtcacccctccaggaggcttgtcgacgaaaagcctgttcgaatctaccagacccgttaaatggccaagttagctacccaaatggggatatgctgtttggttcaaaggctcagtttacctgtaacactggtttttacataattggagccgagactgtgtattgtcaggtttctgggaatgttatggcctggagtgagccctccccgctatgtgagaagattttgtgtaaaccacctggcgaaattccaaatggaaaatacaccaatagccataaggatgtatttgaatacaatgaagtagtaacttacagttgtctttcttcaactggaccggatgaattttcacttgttggagagagcagccttttttgtattgggaaggacgagtggagtagtgacccccctgagtgtaaagtggtcaaatgtccatatccagtagtcccaaatggagaaattgtatcaggatttggatcaaaattttactacaaagcagaggttgtatttaaatgcaatgctggttttacccttcatggcagagacacaattgtctgcggtgcaaacagcacgtgggagcctgagatgccccaatgtatcaaagattccaagcctactgatccacctgcaaccccaggaccaagccatccaggacctcccagtcccagtgatgcatcaccacctaaagatgctgagagtttagatggaggaatcatcgctgcaattgttgtgggcgtcttagctgccattgcagtaattgctggtggtgtatacttttttcatcataaatacaacaagaaaaggtcgaagtaaaactgatgtgcttaaagtaaaagttgctgagaggacgtggaatccagccccttccctctcctgtgctgctgcctgggtcccgttttgcatgtcatgactgtgtgcttccaaaaaatgccttttgttcgtatttttttgcctaaacgcatgattttgtctctacttgaattaaatcatcactgaatccacgc

SEQ ID NO: 38 - DNA, 1546 bp, Sus scrofa
cggcacgagatttcgtcttaatcgcggaggtcgcagagtccgggagccgctcggggtccccgttcccgcgcgccatgagtcccctgccgcggagcgcccccgcggtgaggcgcctaatgggcggacagacgccgccgccgctgctgctgctgctgctgctgctgtgtatcccggctgcgcagggtgactgcagccttccacccgatgtacctaatgcccaaccagatttgcgaggtcttgcaagttttcctgaacaaaccacaataacatacaaatgtaacaaaggctttgtcaaagttcctggcatggcagactcagtgctctgtcttaatgataaatggtcagaagttgcagaattttgtaatcgtagctgtgatgttccaaccaggctacattttgcatctcttaaaaagtcttacagcaaacagaattatttcccagagggtttcaccgtggaatatgagtgccgtaagggctataaaagggatcttactctatcagaaaaactaacttgccttcagaattttacgtggtccaaacctgatgaattttgcaaaaaaaaacaatgtccgactcctggagaactaaaaaatggtcatgtcaatataacaactgacttgttatttggcgcatccatctttttctcatgtaacgcagggtacagactagttggtgcaacttctagttactgttttgccatagcaaatgatgttgagtggagtgatccattgccagaatgccaagaaatttctccaactgtcaaagccataccagctgttgagaaacccatcacagtaaattttccagcaacaaagtatccagctattcccagggccacaacgagttttcattcaagtacatctaaaaatcgaggaaacccttcttcaggcatgagaatcatgtcgtctggtaccatgctacttattgcaggaggtgttgctgttattataataattgttgccctaattctagccaaaggtttctggcactatggaaaatcaggctcttaccacactcatgagaacaacaaagccgttaatgttgcattttataatttacctgcgactggcgatgccgcagatgtaagacctggtaattaacaaaaggacggtgcatgtgtaacactgacagttttgcttatggtgctagtaaccattggctagctgacttagccaaagaagagttaagaagaaagtgcacacaagtacacagaatattttcagtttcttagaactttcaggtggagtggacatagtttgtggatagtgttcttcgttttgcatgttttcattgtctctaaggtacataggaatgtcacagaaccaaagagaaacaaatctatcctgaaattacatcctcaacactcctaagactcttgaaaatagaacagctcataagattgagagcaattactttccaaaaagggtgagaaaatggagagatttgttcatggttagaatataagaaaaaagaaaacaaaaaggtgatttttcccaccaaatgtgtaatgttatttttattaataaaggaaaaaaaaaaaaaaaaa

SEQ ID NO: 39 - DNA, 773 bp, Sus scrofa
gaaaagacgcgcaggccgggccgctctcccgacggggagtagcgctgcagccggacgcagggtgcagttagaatccatagacggtcacgatgggaagcaaaggagggttcattttgctctggctcctgtccatcctggctgttctctgccacttaggtcacagcctgcagtgctataactgtatcaacccagctggtagctgcactacggccatgaattgttcacataatcaggatgcctgtatcttcgttgaagccgtgccacccaaaacttactaccagtgttggaggttcgatgaatgcaatttcgatttcatttcgagaaacctagcggagaagaagctgaagtacaactgctgccggaaggacctgtgtaacaagagtgatgccacgatttcatcagggaaaaccgctctgctggtgatcctgctgctggtagcaacctggcacttttgtctctaactgtacaccaggagagtttctcctcaacttcctctgtctctctgttcctatttcccatgctgcggtgttccaaaggctgtgtatgctccagcttcttcctgttgggaaggactaaacctagcttgagcactttggattagagagagaaactttgagcgactttgaagaccaggcctgttggcagagaagacctgtcagaggggaaacgttttaagagtgaagcacaggtgatttgagcgaggcctatgcgtcttcctctgctcttggcaggaccagctttgcggtaaccattcgatagattccacaatcctt

SEQ ID NO: 40 - DNA, 261 bp, Human herpesvirus 2
tcaaggggccagcacgcgatcctgccgctcgttcgatctagcacacccacgggtctgctgtgtgggatttcgactcgcgggatccgatcgcacgtccggaggacacagcagcgggagctccgggtcggtcaccgcagttctggccgcctctcggtcctcccgttcccttttatggatctccgcgcagacatcgccatacgtccggtgtgtgcaccgcgaagaatccagaaacatgtccgtcgttttcagggcccaagacat

SEQ ID NO: 41 - DNA, 1578 bp, Homo sapiens
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaacttt

SEQ ID NO: 42 - DNA, 2679 bp, Homo sapiens
gcagactcagttctcattcccaatgggtgtcgggtttctagagaagccaatcagcgtcgccacgactcccgactataaagtccccatccggactcaagaagttctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattgaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcaaaaaaaaaaaaaaaaaa

SEQ ID NO: 43 - DNA, 987 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 44 - DNA, 3349 bp, Homo sapiens
ggcgcaacgctgagcagctggcgcgtcccgcgcggccccagttctgcgcagcttcccgaggctccgcaccagccgcgcttctgtccgcctgcagggcattccagaaagatgaggatatttgctgtctttatattcatgacctactggcatttgctgaacgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagttaaaaaa

SEQ ID NO: 45 - DNA, 2418 bp, Homo sapiens
gcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggta

SEQ ID NO: 46 - DNA, 4167 bp, Homo sapiens
agcgggagtccgcggcgagcgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaattgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccatcacacccagctaattttgtatttttcagtagagacggggtttcgccacattggccgtgttggtcttgaactcctggcctcaagcgatccgcctacctcagcctcccaaagtgctaggattacaggcataagccactgagcccagccctagttcagtatcttttatgtaaattacaaacatctgcaacattatgtatcatatgcagatacttattgcatttcttttattagtggtgaaagtgttctatgcatttattggctcttgaatttcctcatctatgaattgtcattcatacacctacttttctgcttcgtttttacatatgtctttgcctattaaagatattatccctctgttttatattttctctcattcttgtattgccttttaaattttgttatgatgtttcattaataaacagtgttttgttttcctctataatcaaaaaaaaaaaaaaaaaaa

SEQ ID NO: 47 - DNA, 5346 bp, Homo sapiens
ggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtc

SEQ ID NO: 48 - DNA, 1835 bp, Homo sapiens
tccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattcaaaaaaaaaaaaaaaaaaaaaaaaaaaaaaaaaaaaaaaaaaaaaaaaaaaaaaaaaaaaaaaaaaaaaaaa

SEQ ID NO: 49 - protein, 363 aa, Sus scrofa
MMAFCALRKALPCRPENPFSSRCFVEILWVSLALVFLLPMPSDACDEPPKFESMRPQFLNTTYRPGDRVEYECRPGFQPMVPALPTFSVCQDDNTWSPLQEACRRKACSNLPDPLNGQVSYPNGDMLFGSKAQFTCNTGFYIIGAETVYCQVSGNVMAWSEPSPLCEKILCKPPGEIPNGKYTNSHKDVFEYNEVVTYSCLSSTGPDEFSLVGESSLFCIGKDEWSSDPPECKVVKCPYPVVPNGEIVSGFGSKFYYKAEVVFKCNAGFTLHGRDTIVCGANSTWEPEMPQCIKDSKPTDPPATPGPSHPGPPSPSDASPPKDAESLDGGIIAAIVVGVLAAIAVIAGGVYFFHHKYNKKRSK

SEQ ID NO: 50 - protein, 341 aa, Sus scrofa
MSPLPRSAPAVRRLMGGQTPPPLLLLLLLLCIPAAQGDCSLPPDVPNAQPDLRGLASFPEQTTITYKCNKGFVKVPGMADSVLCLNDKWSEVAEFCNRSCDVPTRLHFASLKKSYSKQNYFPEGFTVEYECRKGYKRDLTLSEKLTCLQNFTWSKPDEFCKKKQCPTPGELKNGHVNITTDLLFGASIFFSCNAGYRLVGATSSYCFAIANDVEWSDPLPECQEISPTVKAIPAVEKPITVNFPATKYPAIPRATTSFHSSTSKNRGNPSSGMRIMSSGTMLLIAGGVAVIIIIVALILAKGFWHYGKSGSYHTHENNKAVNVAFYNLPATGDAADVRPGN

SEQ ID NO: 51 - protein, 123 aa, Sus scrofa
MGSKGGFILLWLLSILAVLCHLGHSLQCYNCINPAGSCTTAMNCSHNQDACIFVEAVPPKTYYQCWRFDECNFDFISRNLAEKKLKYNCCRKDLCNKSDATISSGKTALLVILLLVATWHFCL

SEQ ID NO: 52 - protein, 86 aa, Human herpesvirus 2
MSWALKTTDMFLDSSRCTHRTYGDVCAEIHKREREDREAARTAVTDPELPLLCPPDVRSDPASRNPTQQTRGCARSNERQDRVLAP

SEQ ID NO: 53 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 54 - protein, 358 aa, Homo sapiens
MVDGTLLLLLSEALALTQTWAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 55 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 56 - protein, 176 aa, Homo sapiens
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 57 - protein, 273 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 58 - protein, 376 aa, Homo sapiens
METLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 59 - protein, 323 aa, Homo sapiens
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 60 - protein, 355 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 61 - DNA, 20 bp, Artificial Sequence
  Description of Artificial Sequence: Synthetic oligonucleotide
ggggaggaagaacttcacct

SEQ ID NO: 62 - DNA, 20 bp, Artificial Sequence
  Description of Artificial Sequence: Synthetic oligonucleotide
gtaggacgaccctctgtgtg

SEQ ID NO: 63 - DNA, 20 bp, Artificial Sequence
  Description of Artificial Sequence: Synthetic oligonucleotide
gaccctctgtgtggggtctg

SEQ ID NO: 64 - DNA, 20 bp, Artificial Sequence
  Description of Artificial Sequence: Synthetic oligonucleotide
ggctcggttccattgcaaga

SEQ ID NO: 65 - DNA, 20 bp, Artificial Sequence
  Description of Artificial Sequence: Synthetic oligonucleotide
gctcggttccattgcaagat

SEQ ID NO: 66 - DNA, 20 bp, Artificial Sequence
  Description of Artificial Sequence: Synthetic oligonucleotide
ggttccattgcaagatgggc

SEQ ID NO: 67 - DNA, 20 bp, Artificial Sequence
  Description of Artificial Sequence: Synthetic oligonucleotide
gtcccctcctgagtgtcgaa

SEQ ID NO: 68 - DNA, 20 bp, Artificial Sequence
  Description of Artificial Sequence: Synthetic oligonucleotide
gcctcaggtacagatcaaaa

SEQ ID NO: 69 - DNA, 20 bp, Artificial Sequence
  Description of Artificial Sequence: Synthetic oligonucleotide
ggacctgggtgccaggaacg

SEQ ID NO: 70 - DNA, 20 bp, Artificial Sequence
  Description of Artificial Sequence: Synthetic oligonucleotide
gtacccagagtcagatcacc

SEQ ID NO: 71 - DNA, 20 bp, Artificial Sequence
  Description of Artificial Sequence: Synthetic oligonucleotide
gtacccagagtcagatcacc

SEQ ID NO: 72 - DNA, 20 bp, Artificial Sequence
  Description of Artificial Sequence: Synthetic oligonucleotide
gtgcccttcgacactcagga

SEQ ID NO: 73 - DNA, 20 bp, Artificial Sequence
  Description of Artificial Sequence: Synthetic oligonucleotide
gtgcccttcgacactcagga

SEQ ID NO: 74 - DNA, 20 bp, Artificial Sequence
  Description of Artificial Sequence: Synthetic oligonucleotide
gtgcccttcgacactcagga

SEQ ID NO: 75 - DNA, 20 bp, Artificial Sequence
  Description of Artificial Sequence: Synthetic oligonucleotide
gggggccccaaggcagaaga

SEQ ID NO: 76 - DNA, 20 bp, Artificial Sequence
  Description of Artificial Sequence: Synthetic oligonucleotide
ggcagtcttccagtacctgg

SEQ ID NO: 77 - DNA, 26 bp, Artificial Sequence
  Description of Artificial Sequence: Synthetic oligonucleotide
acaccggggaggaagaacttcacctg

SEQ ID NO: 78 - DNA, 26 bp, Artificial Sequence
  Description of Artificial Sequence: Synthetic oligonucleotide
aaaacaggtgaagttcttcctccccg

SEQ ID NO: 79 - DNA, 26 bp, Artificial Sequence
  Description of Artificial Sequence: Synthetic oligonucleotide
acaccgtaggacgaccctctgtgtgg

SEQ ID NO: 80 - DNA, 26 bp, Artificial Sequence
  Description of Artificial Sequence: Synthetic oligonucleotide
aaaaccacacagagggtcgtcctacg

SEQ ID NO: 81 - DNA, 26 bp, Artificial Sequence
  Description of Artificial Sequence: Synthetic oligonucleotide
acaccgaccctctgtgtggggtctgg

SEQ ID NO: 82 - DNA, 26 bp, Artificial Sequence
  Description of Artificial Sequence: Synthetic oligonucleotide
aaaaccagaccccacacagagggtcg

SEQ ID NO: 83 - DNA, 26 bp, Artificial Sequence
  Description of Artificial Sequence: Synthetic oligonucleotide
acaccggctcggttccattgcaagag

SEQ ID NO: 84 - DNA, 26 bp, Artificial Sequence
  Description of Artificial Sequence: Synthetic oligonucleotide
aaaactcttgcaatggaaccgagccg

SEQ ID NO: 85 - DNA, 26 bp, Artificial Sequence
  Description of Artificial Sequence: Synthetic oligonucleotide
acaccgctcggttccattgcaagatg

SEQ ID NO: 86 - DNA, 26 bp, Artificial Sequence
  Description of Artificial Sequence: Synthetic oligonucleotide
aaaacatcttgcaatggaaccgagcg

SEQ ID NO: 87 - DNA, 26 bp, Artificial Sequence
  Description of Artificial Sequence: Synthetic oligonucleotide
acaccggttccattgcaagatgggcg

SEQ ID NO: 88 - DNA, 26 bp, Artificial Sequence
  Description of Artificial Sequence: Synthetic oligonucleotide
aaaacgcccatcttgcaatggaaccg

SEQ ID NO: 89 - DNA, 26 bp, Artificial Sequence
  Description of Artificial Sequence: Synthetic oligonucleotide
acaccgtcccctcctgagtgtcgaag

SEQ ID NO: 90 - DNA, 26 bp, Artificial Sequence
  Description of Artificial Sequence: Synthetic oligonucleotide
aaaacttcgacactcaggaggggacg

SEQ ID NO: 91 - DNA, 26 bp, Artificial Sequence
  Description of Artificial Sequence: Synthetic oligonucleotide
acaccgcctcaggtacagatcaaaag

SEQ ID NO: 92 - DNA, 26 bp, Artificial Sequence
  Description of Artificial Sequence: Synthetic oligonucleotide
aaaacttttgatctgtacctgaggcg

SEQ ID NO: 93 - DNA, 26 bp, Artificial Sequence
  Description of Artificial Sequence: Synthetic oligonucleotide
acaccggacctgggtgccaggaacgg

SEQ ID NO: 94 - DNA, 26 bp, Artificial Sequence
  Description of Artificial Sequence: Synthetic oligonucleotide
aaaaccgttcctggcacccaggtccg

SEQ ID NO: 95 - DNA, 26 bp, Artificial Sequence
  Description of Artificial Sequence: Synthetic oligonucleotide
acaccgtacccagagtcagatcaccg

SEQ ID NO: 96 - DNA, 26 bp, Artificial Sequence
  Description of Artificial Sequence: Synthetic oligonucleotide
aaaacggtgatctgactctgggtacg

SEQ ID NO: 97 - DNA, 26 bp, Artificial Sequence
  Description of Artificial Sequence: Synthetic oligonucleotide
acaccgtacccagagtcagatcaccg

SEQ ID NO: 98 - DNA, 26 bp, Artificial Sequence
  Description of Artificial Sequence: Synthetic oligonucleotide
aaaacggtgatctgactctgggtacg

SEQ ID NO: 99 - DNA, 26 bp, Artificial Sequence
  Description of Artificial Sequence: Synthetic oligonucleotide
acaccgtgcccttcgacactcaggag

SEQ ID NO: 100 - DNA, 26 bp, Artificial Sequence
  Description of Artificial Sequence: Synthetic oligonucleotide
aaaactcctgagtgtcgaagggcacg

SEQ ID NO: 101 - DNA, 26 bp, Artificial Sequence
  Description of Artificial Sequence: Synthetic oligonucleotide
acaccgtgcccttcgacactcaggag

SEQ ID NO: 102 - DNA, 26 bp, Artificial Sequence
  Description of Artificial Sequence: Synthetic oligonucleotide
aaaactcctgagtgtcgaagggcacg

SEQ ID NO: 103 - DNA, 26 bp, Artificial Sequence
  Description of Artificial Sequence: Synthetic oligonucleotide
acaccgtgcccttcgacactcaggag

SEQ ID NO: 104 - DNA, 26 bp, Artificial Sequence
  Description of Artificial Sequence: Synthetic oligonucleotide
aaaactcctgagtgtcgaagggcacg

SEQ ID NO: 105 - DNA, 26 bp, Artificial Sequence
  Description of Artificial Sequence: Synthetic oligonucleotide
acaccgggggccccaaggcagaagag

SEQ ID NO: 106 - DNA, 26 bp, Artificial Sequence
  Description of Artificial Sequence: Synthetic oligonucleotide
aaaactcttctgccttggggcccccg

SEQ ID NO: 107 - DNA, 26 bp, Artificial Sequence
  Description of Artificial Sequence: Synthetic oligonucleotide
acaccggcagtcttccagtacctggg

SEQ ID NO: 108 - DNA, 26 bp, Artificial Sequence
  Description of Artificial Sequence: Synthetic oligonucleotide
aaaacccaggtactggaagactgccg

SEQ ID NO: 109 - DNA, 24 bp, Artificial Sequence
  Description of Artificial Sequence: Synthetic oligonucleotide
caccgagaaaataatgaatgtcaa

SEQ ID NO: 110 - DNA, 24 bp, Artificial Sequence
  Description of Artificial Sequence: Synthetic oligonucleotide
aaacttgacattcattattttctc

SEQ ID NO: 111 - DNA, 24 bp, Artificial Sequence
  Description of Artificial Sequence: Synthetic oligonucleotide
caccgagtaaggtacgtgatctgt

SEQ ID NO: 112 - DNA, 24 bp, Artificial Sequence
  Description of Artificial Sequence: Synthetic oligonucleotide
aaacacagatcacgtaccttactc

SEQ ID NO: 113 - DNA, 26 bp, Artificial Sequence
  Description of Artificial Sequence: Synthetic oligonucleotide
acaccgcaaggggatattcgggtttg

SEQ ID NO: 114 - DNA, 26 bp, Artificial Sequence
  Description of Artificial Sequence: Synthetic oligonucleotide
aaaacaaacccgaatatccccttgcg

SEQ ID NO: 115 - DNA, 26 bp, Artificial Sequence
  Description of Artificial Sequence: Synthetic oligonucleotide
acaccgtgcttttggtcctgagcgtg

SEQ ID NO: 116 - DNA, 26 bp, Artificial Sequence
  Description of Artificial Sequence: Synthetic oligonucleotide
aaaacacgctcaggaccaaaagcacg

SEQ ID NO: 117 - DNA, 26 bp, Artificial Sequence
  Description of Artificial Sequence: Synthetic oligonucleotide
acaccgtcgatcctcaagatattgag

SEQ ID NO: 118 - DNA, 26 bp, Artificial Sequence
  Description of Artificial Sequence: Synthetic oligonucleotide
aaaactcaatatcttgaggatcgacg

SEQ ID NO: 119 - DNA, 26 bp, Artificial Sequence
  Description of Artificial Sequence: Synthetic oligonucleotide
acaccggggagagaagcagaggatgg

SEQ ID NO: 120 - DNA, 26 bp, Artificial Sequence
  Description of Artificial Sequence: Synthetic oligonucleotide
aaaaccatcctctgcttctctccccg

SEQ ID NO: 121 - DNA, 26 bp, Artificial Sequence
  Description of Artificial Sequence: Synthetic oligonucleotide
acaccgtagaaaaggatgaagaaaag

SEQ ID NO: 122 - DNA, 26 bp, Artificial Sequence
  Description of Artificial Sequence: Synthetic oligonucleotide
aaaacttttcttcatccttttctacg

SEQ ID NO: 123 - DNA, 26 bp, Artificial Sequence
  Description of Artificial Sequence: Synthetic oligonucleotide
acaccggcctcagaccccacacagag

SEQ ID NO: 124 - DNA, 26 bp, Artificial Sequence
  Description of Artificial Sequence: Synthetic oligonucleotide
aaaactctgtgtggggtctgaggccg

SEQ ID NO: 125 - DNA, 22 bp, Artificial Sequence
  Description of Artificial Sequence: Synthetic primer
gccttttgctggccttttgctc

SEQ ID NO: 126 - DNA, 28 bp, Artificial Sequence
  Description of Artificial Sequence: Synthetic primer
cgggccatttaccgtaagttatgtaacg

SEQ ID NO: 127 - DNA, 20 bp, Artificial Sequence
  Description of Artificial Sequence: Synthetic primer
tctgattggctgctgaagtc

SEQ ID NO: 128 - DNA, 22 bp, Artificial Sequence
  Description of Artificial Sequence: Synthetic primer
gtagccagcaagtcatgaaatc

SEQ ID NO: 129 - DNA, 20 bp, Artificial Sequence
  Description of Artificial Sequence: Synthetic primer
gggagtattgctgaacctca

SEQ ID NO: 130 - DNA, 21 bp, Artificial Sequence
  Description of Artificial Sequence: Synthetic primer
tcttgactaccactgcgattg

SEQ ID NO: 131 - DNA, 22 bp, Artificial Sequence
  Description of Artificial Sequence: Synthetic primer
gttaggagccagtaatggagtt

SEQ ID NO: 132 - DNA, 22 bp, Artificial Sequence
  Description of Artificial Sequence: Synthetic primer
agtgtctctgtctccagtatct

SEQ ID NO: 133 - DNA, 25 bp, Artificial Sequence
  Description of Artificial Sequence: Synthetic primer
ttggtaaatagcaatcaactcagtg

SEQ ID NO: 134 - DNA, 21 bp, Artificial Sequence
  Description of Artificial Sequence: Synthetic primer
tttctgctcaagtcacactga

SEQ ID NO: 135 - DNA, 23 bp, Artificial Sequence
  Description of Artificial Sequence: Synthetic primer
caagcaatgacaacaacctgata

SEQ ID NO: 136 - DNA, 22 bp, Artificial Sequence
  Description of Artificial Sequence: Synthetic primer
ttgctttctcctgatcccatag

SEQ ID NO: 137 - DNA, 23 bp, Artificial Sequence
  Description of Artificial Sequence: Synthetic primer
cagtgctaatctagagcactacc

SEQ ID NO: 138 - DNA, 23 bp, Artificial Sequence
  Description of Artificial Sequence: Synthetic primer
cattctcctgaagagctcagaat

SEQ ID NO: 139 - DNA, 23 bp, Artificial Sequence
  Description of Artificial Sequence: Synthetic primer
tccattgggctttgtctatactt

SEQ ID NO: 140 - DNA, 24 bp, Artificial Sequence
  Description of Artificial Sequence: Synthetic primer
gacaaaggaaattagcagagaacc

SEQ ID NO: 141 - DNA, 23 bp, Artificial Sequence
  Description of Artificial Sequence: Synthetic primer
aactggtctttcccttggatatt

SEQ ID NO: 142 - DNA, 20 bp, Artificial Sequence
  Description of Artificial Sequence: Synthetic primer
ctggctgcagcatcaatatc

SEQ ID NO: 143 - DNA, 22 bp, Artificial Sequence
  Description of Artificial Sequence: Synthetic primer
gcctctattaattgcctttccc

SEQ ID NO: 144 - DNA, 19 bp, Artificial Sequence
  Description of Artificial Sequence: Synthetic primer
ccattcacttcgcatccct

SEQ ID NO: 145 - DNA, 18 bp, Artificial Sequence
  Description of Artificial Sequence: Synthetic primer
cgggaagtcgggagcata

SEQ ID NO: 146 - DNA, 18 bp, Artificial Sequence
  Description of Artificial Sequence: Synthetic primer
gaggagaagcggccaatc

SEQ ID NO: 147 - DNA, 23 bp, Artificial Sequence
  Description of Artificial Sequence: Synthetic primer
ctgctcttctcttgtcactgatt

SEQ ID NO: 148 - DNA, 17 bp, Artificial Sequence
  Description of Artificial Sequence: Synthetic primer
gcgggagccactttcac

SEQ ID NO: 149 - DNA, 20 bp, Artificial Sequence
  Description of Artificial Sequence: Synthetic primer
tctgattggctgctgaagtc

SEQ ID NO: 150 - DNA, 20 bp, Artificial Sequence
  Description of Artificial Sequence: Synthetic primer
cgagagcaggtagagctagt

SEQ ID NO: 151 - DNA, 20 bp, Artificial Sequence
  Description of Artificial Sequence: Synthetic primer
ggagtgccgcaataccttta

SEQ ID NO: 152 - DNA, 21 bp, Artificial Sequence
  Description of Artificial Sequence: Synthetic primer
cctggactcatttcccatctc

SEQ ID NO: 153 - DNA, 20 bp, Artificial Sequence
  Description of Artificial Sequence: Synthetic primer
gggtggagatgggaaatgag

SEQ ID NO: 154 - DNA, 22 bp, Artificial Sequence
  Description of Artificial Sequence: Synthetic primer
gctacaccaccaaagtatagca

SEQ ID NO: 155 - DNA, 23 bp, Artificial Sequence
  Description of Artificial Sequence: Synthetic primer
tggtggtggaacttatctgattt

SEQ ID NO: 156 - DNA, 21 bp, Artificial Sequence
  Description of Artificial Sequence: Synthetic primer
agggggtacacattctcctga

SEQ ID NO: 157 - DNA, 20 bp, Artificial Sequence
  Description of Artificial Sequence: Synthetic primer
gacctctgggttccattggg

SEQ ID NO: 158 - DNA, 20 bp, Artificial Sequence
  Description of Artificial Sequence: Synthetic primer
caaagcccaatggaacccag

SEQ ID NO: 159 - DNA, 20 bp, Artificial Sequence
  Description of Artificial Sequence: Synthetic primer
gaaggggctttcccaacagt

SEQ ID NO: 160 - DNA, 20 bp, Artificial Sequence
  Description of Artificial Sequence: Synthetic primer
gcccaagacagggaaaacga

SEQ ID NO: 161 - DNA, 20 bp, Artificial Sequence
  Description of Artificial Sequence: Synthetic primer
tgacaactctggtcgctctg

SEQ ID NO: 162 - DNA, 20 bp, Artificial Sequence
  Description of Artificial Sequence: Synthetic primer
cagagagcctcggctaggta

SEQ ID NO: 163 - DNA, 20 bp, Artificial Sequence
  Description of Artificial Sequence: Synthetic primer
aatggctccgtccgtattcc

SEQ ID NO: 164 - DNA, 20 bp, Artificial Sequence
  Description of Artificial Sequence: Synthetic primer
gggaagtcgggagcatatcg

SEQ ID NO: 165 - DNA, 20 bp, Artificial Sequence
  Description of Artificial Sequence: Synthetic primer
cactcccgaggctgtaactg

SEQ ID NO: 166 - DNA, 20 bp, Artificial Sequence
  Description of Artificial Sequence: Synthetic primer
atggcgtgttttggttggag

SEQ ID NO: 167 - DNA, 20 bp, Artificial Sequence
  Description of Artificial Sequence: Synthetic primer
ggagccactttcactgaccc

SEQ ID NO: 168 - DNA, 20 bp, Artificial Sequence
  Description of Artificial Sequence: Synthetic primer
gggagggtcagtgaaagtgg

SEQ ID NO: 169 - DNA, 19 bp, Artificial Sequence
  Description of Artificial Sequence: Synthetic primer
gagggccgtaccaaagacc

SEQ ID NO: 170 - DNA, 20 bp, Artificial Sequence
  Description of Artificial Sequence: Synthetic primer
ggtcccaaatgagcgaaacc

SEQ ID NO: 171 - DNA, 20 bp, Artificial Sequence
  Description of Artificial Sequence: Synthetic primer
gggtccgagagcaggtagag

SEQ ID NO: 172 - DNA, 20 bp, Artificial Sequence
  Description of Artificial Sequence: Synthetic primer
ccgcctgaaggacgagacta

SEQ ID NO: 173 - DNA, 20 bp, Artificial Sequence
  Description of Artificial Sequence: Synthetic primer
cagggcggtccttaggaaaa

SEQ ID NO: 174 - DNA, 20 bp, Artificial Sequence
  Description of Artificial Sequence: Synthetic primer
gggagtgccgcaataccttt

SEQ ID NO: 175 - DNA, 20 bp, Artificial Sequence
  Description of Artificial Sequence: Synthetic primer
gaaattgggctcgtcctcgt

SEQ ID NO: 176 - DNA, 20 bp, Artificial Sequence
  Description of Artificial Sequence: Synthetic primer
cgaggacgagcccaatttct

SEQ ID NO: 177 - DNA, 20 bp, Artificial Sequence
  Description of Artificial Sequence: Synthetic primer
agtgagggggcctaaggttt

SEQ ID NO: 178 - DNA, 20 bp, Artificial Sequence
  Description of Artificial Sequence: Synthetic primer
actaccactgcgattggacc

SEQ ID NO: 179 - DNA, 21 bp, Artificial Sequence
  Description of Artificial Sequence: Synthetic primer
aggagccagtaatggagttgt

SEQ ID NO: 180 - DNA, 22 bp, Artificial Sequence
  Description of Artificial Sequence: Synthetic primer
cacaactccattactggctcct

SEQ ID NO: 181 - DNA, 20 bp, Artificial Sequence
  Description of Artificial Sequence: Synthetic primer
ggagggtagcattccagagg

SEQ ID NO: 182 - DNA, 19 bp, Artificial Sequence
  Description of Artificial Sequence: Synthetic primer
ccattcacttcgcatccct

SEQ ID NO: 183 - DNA, 22 bp, Artificial Sequence
  Description of Artificial Sequence: Synthetic primer
ttgcagatgattgcttcctttc

SEQ ID NO: 184 - DNA, 21 bp, Artificial Sequence
  Description of Artificial Sequence: Synthetic primer
agggggtacacattctcctga

SEQ ID NO: 185 - DNA, 20 bp, Artificial Sequence
  Description of Artificial Sequence: Synthetic primer
gacctctgggttccattggg

SEQ ID NO: 186 - DNA, 20 bp, Artificial Sequence
  Description of Artificial Sequence: Synthetic primer
gaaggggctttcccaacagt

SEQ ID NO: 187 - DNA, 20 bp, Artificial Sequence
  Description of Artificial Sequence: Synthetic primer
gtggcgtatgccccagtatc

SEQ ID NO: 188 - DNA, 4524 bp, Artificial Sequence
  Description of Artificial Sequence: Synthetic polynucleotide
aagaaatttttcccaaatagggggtacacattctcctgaagagctcagaatactcaactcagctggatcctactcaaagtattgctaaataacatctgcccaacaataaaaaaaatgtaaatatgaccttggtcacaaatatgtcatttaaatgcaacttgtttaataaaatgacaaaggaaattagcagagaacctggggattctttcagtactatgagcatggggaaaactagaaaaatgaactaagtatagacaaagcccaatggaacccagaggtctgggcaaaaaatgacttggtggtgaacacattgcacaagtaacatgagaaagcagaaaatgcaggtcatacacgcacccctgacccagaccagcagagctggctgcagcatcaatatccaagggaaagaccagttattctcaagaagtgagacaagcaaagagctctatagaataaattagcatagaaggggctttcccaacagttaaactttccctgtcacgcgattcacctacttaaaaaccagggctttttctcaccaccattcacttcgcatccctggcttccacgcagagggaaaggcaattaatagaggctacatttttctgcctttaaagatattctcaaatgatctctctccacgcccaagacagggaaaacgacacaatctggctcaactccaagctagaaccctacaaattcagtggggccatttcagagatactggggcatacgccactgagagcccaagaatgtgaggtgggggtggcgaagcccaacgtctttagtgtgggaaaggaagcaatcatctgcaatagggaccctaggacgagaggaaaagcgtccaggaacattcttggaggggggagatcgagggccccagagcgaccagagttgtcacaaggccgcgcgaacgggggtgggggtggggtttggggaggggaaaaaaaagtgtgctgtgtattttgaggagggcggcgagaggcctattctcaagtaaaaggtaaacgtggagtaggcagttcacaggaaaaggggtgaagaggcgtggggggaggggaaacgtcctgacccaggaaagacatgaaaagggtagtggggtcgactagattaaggagggggcctctccgcctgggaaagaggggtacagtggtgtgggggggcgaggggggatgggaaggggcagcatcctcctgctgagagccgggggagggccaggcccacgtcccgagagcaagcgcgaggagacggaggaggtgacccttccctcccccggggcccggtggtgaggggaggtctctcttttctgtcgcacccttaccttgtcccaggcctgggcccgggctgcggcgcacggcactcccggtaggcagcaggactcgagttaggcccagcgcggcgccacggcgtttcctggccgggaatggcccgtgcccgtgaggtgggggtggggggcaaaaaggcggagcgagccaaaggcggtgaggggggagggccagggaaggaggggggggccggcactactgtgttggcggactggcgggactggggctgcgtgagtctctgagcgcaggcgggcggcggccgcccctcccccggcggcggcggcggcggcggcggcggcggcagcagctcactcagcccgctgcccgagcggaaacgccactgaccgcacggggattcccagcgccggcgccaggggcacccgggacacgccccctcccgccgcgccattggcccctccgcccaccgtctcgcacccattggccagctccccgccaatcagcggaagccgccggggccgcctagagaagaggctgtgctctggggctccggctcctcagagagcctcggctaggtaggggagcgggactctggtttgggggagggccggcggtttggcgggggatgggtgcttgaggtggtctgaccggtagcgggggtcgccttccctagcgggaagtcgggagcatatcgtttgttacgctggaaggggaagaggtggtgagaggcaggcgggagtgcggcccgccctgcggcaaccggagggggagggagaagggagcggaaaagcctggaatacggacggagccattgctcccgcagagggaggagcgcttcctgctcttctcttgtcactgattggccgcttctcctcccgccgtgtgtgaaaacacaaatggcgtgttttggttggagtaaagctcctgtcagttacagcctcgggagtgcgcagcctcccaggaactctcgcattgccccctgggtgggtaggtaggtggggtggagagagctgcacaagagggcgctgtcggcctcctgcggggggaggggagggtcagtgaaagtggctcccgcgcgggcgtcctgccaccctcccctccgggggagtcggtttacccgccgcctgctcggctttggtatctgattggctgctgaagtcctgggaacggccccttgttattggcttgggtcccaaatgagcgaaaccactacgcgagtcggcagggaggcggtctttggtacggccctccccgaggccagcgccgcagtgtctggcccctcgcccctgcgcaacgtggcaggaagcgcgcgcaggaggcgggggcgggctgccgggccgaggcttctgggtggtggtgactgcggctccgccctgggcgtccgccgcctgaaggacgagactagctctacctgctctcggacccgtgggggtggggggtggaggaagtgagtggggggtcggtcctgctggcttgtgggtgggaggcgcatgttctccaaaaacccgcgcgagctgcaatcctgagggagctgcagtggaggaggcggagagaaggcgcacccttctccgcagggggaggggagtgccgcaatacctttatgggagttctctgctgcctccttttcctaaggaccgccctgggcctagaaaaatccctccctcccccgcgatctcgtcatcgcctccatgtcagtttgctccttctcgattatgggcgggattcttttgccctggcttaacctgattcttgggcgttgtcctgcaggggattgagcaggtgtacgaggacgagcccaatttctctatattcccacagtcttgagtttgtgtcacaaaataattatagtggggtggagatgggaaatgagtccaggcaacacctaagcctgattttatgcattgagactgcgtgttattactaaagatctttgtgtcgcaatttcctgatgaagggagataggttaaaaagcacggatctactgagttttacagtcatcccatttgtagacttttgctacaccaccaaagtatagcatctgagattaaatattaatctccaaaccttaggccccctcacttgcatccttacggtcagataactctcactcatactttaagcccattttgtttgttgtacttgctcatccagtcccagacatagcattggctttctcctcacctgttttaggtagccagcaagtcatgaaatcagataagttccaccaccaattaacactacccatcttgagcataggcccaacagtgcatttattcctcatttactgatgttcgtgaatatttaccttgattttcatttttttctttttcttaagctgggattttactcctgaccctattcacagtcagatgatcttgactaccactgcgattggacctgaggttcagcaatactcccctttatgtcttttgaatacttttcaataaatctgtttgtattttcattagttagtaactgagctcagttgccgtaatgctaatagcttccaaactagtgtctctgtctccagtatctgataaatcttaggtgttgctgggacagttgtcctaaaattaagataaagcatgaaaataactgacacaactccattactggctcctaactacttaaacaatgcattctatcttcacaaatgtgaaaaaggagttccctcagtggactaaccttatcttttctcaacacctttttctttgcacaattttccacacatgcctacaaaaagtacttttctgctcaagtcacactgagttgattgctatttaccaaaatcaaagtaacattatcagatctctgtagggtggttccctctggaatgctaccctccatagtccttacccttcaagtaaagagcatgaagactgaaatatctcctctgtgatctgtcatcctttaagccagaatcccccataaaaaagttagtattgctttctcctgatcccatagcaggttgaatcatagcacttatcaggttgttgtcattgcttgcttaaattctcctaactatttggagcttcttgagggcacaggttcttgttgagtcttgtacctaagcacctagtatagtccttgatgtctagccaaccctaaataaaatgcagtgagtgacatgtagatgtctttataaggtttgataggttggtctctcaaatagttcttttgtatgtttggtagtgctctagattagcactggccagtataactctgatgatggaaatgttct

SEQ ID NO: 189 - DNA, 26 bp, Artificial Sequence
  Description of Artificial Sequence: Synthetic oligonucleotide
acaccgccggggccgcctagagaagg

SEQ ID NO: 190 - DNA, 26 bp, Artificial Sequence
  Description of Artificial Sequence: Synthetic oligonucleotide
aaaaccttctctaggcggccccggcg

SEQ ID NO: 191 - DNA, 4144 bp, Homo sapiens
agtgtggtactttgtcttgaggagatgtcctggactcacacggaaacttagggctacggaatgaaggtaaatttaaaataaaacaagcgggagtcacagatacactgtctgggaaagtgaaacttaagagctttgtgagtcgtgttgtaatgcttttagatgcatttatataccaacaggccaaagtcacattttttaccgattagattcctgatcattcaggggttaccaaggttatgctacccactatagttaataaacaaaaagcaaactggtctctattctatctcatgcactcaggcacaacttttccagatttaagggggaaaaaaaaccctgtctttacacctacaatcccagggcgagctcactctctggcaacaagctccctggggtgatttttcttctagaagagtacaggaggacaggcaaggagtgggaggcagggagtccagttcagggacagggattccgggatgaaaagtgaagggagagggccagggaccttgccgagggtttctccctggtttctcagacagctcctgggccaagactcagggagacactgagacagaacgcttggcacaagagtagcggggtcagggcgaagtcccagggcctcaagcgtggctctcagggtctcaggccccacaggcggtgtatgggttggggaggccccgcgttggggattctctcctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacagcccctgcgcggaggagggaggggccggcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagtgagtaactccggcccagggagcagatcacgacccccacctccatgccccacggacggcccgggtactcccgagtctccgggtctgggatccaccccgaggccgcgggacccgcccagaccctctacctgggagaaccccaaggcgcctttaccaaaatccccgcgggtgggtccgggcgagggcgaggctcggtgggcggggctgaccgagggggtggggccaggttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcgggtaccaggggcagtggggcgcctccctgatctcctgtagacctctcagcctggcctagcacaaggagaggaggaaaatgggaccaacactagaatatcgccctccctctggtcctgagggagaggaatcctcctgggtttccagatcctgtaccagagagtgattctgagggtccgtcctgctctctgggacaattaagggatgaagtctctgagggagtggaggggaagacaatccctggaagactgatcaggggttccctttgaccccacagcagccttggcaccaggacttttcccctcaggccttgttctctgcctcacactcaatgtgtgtgggggtctgactccagctcctctgagtcccttggcctccactcaggtcagaaccggaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgagagatgcaaagtgcttgaattttctgactcttcctttcagacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagtaaggagggagatggaggcatcatgtctgttagggaaagcaggagcctctctgaagacctttaacagggtcggtggtgagggctgggggtcagagaccctcaccttcacctcctttcccagagcagtcttccctgcccaccatccccatcatgggtatcgttgctggcctggttgtccttgcagctgtagtcactggagctgcggtcgctgctgtgctgtggagaaagaagagctcaggtaaggaaggggtgacaagtggggtctgagttttcttgtcccactgggggtttcaagccccaggtagaagtgtgccctgcctggttactgggaagcaccatccacactcatgggcctacccagcctgggccctgtgtgccagcaccttctcttttgtaaagcacctgtgacaatgaaggacagatttattaccttgatgattgtagtgatggggacctgatcccagtaatcacaggtcaggagaaggtccctggctaaggacagaccttaggagggcagttggtcgaggacccacatctgctttccttgtttttcctgatcccgccctgggtctgcagtcacacatttctggaaacttctcgagggtccaagactaggaggttcctctaggacctcatggccctgccacctttctggcctctcacaggacattttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgaggggaacaggggacatagctgtgctatgaggtttctttgacttcaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaacttt

SEQ ID NO: 192 - DNA, 78363 bp, Sus scrofa
  modified_base (240)..(339): a, c, t, g, unknown or other
  modified_base (426)..(426): a, c, t, g, unknown or other
  modified_base (594)..(594): a, c, t, g, unknown or other
  modified_base (16598)..(16697): a, c, t, g, unknown or other
  modified_base (67665)..(67764): a, c, t, g, unknown or other
attcctttcttatttccttttgtgtatatcctatagctattttctttggagttgtcatggggattacatttaacatcctaaaattataaaacttaaattagaatttataccagtttaacttcaataaaacaccaaaactctgttcctttacagctgtctccccatctcttgtagttgttgatatcacaaaattgcatctttgtacattgtgtgccccaagacataaactaataattcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaattattagcaacaaattggagtacaagtataatgatctggctttagaaaggaatttattaaatggttgtttgtttattantaatttggtcttttgtcttaggggctgcactcacggcatatggagttctcaaggctaggatccaatcggaactgtagccaccagcctacaccagaggcacagcaacacaggatccaagccacatctgtgacctacaccacagctcatggcaatgctggatccttaacncactgagcgaggccagggatcaaacctgcatcctcatggttcctagttggatttgtttttgctgcacttataggaactcccatatttaaatttttaattttatttttaaaaaattatttttattaaagtatagttgatttacagtgctgtgaaaatttctgctgtacagcaaagtgattcatatatatgagacattcatatatatatatacacatatatacatatacattcatatatatacattctcatatatatatatatacacacattcatttttctttaaaatatggaacccttcataaatttgtatgtcatccttcacagaggccatactaatcttttaaatattgttcccattttagtgtatgtgctgctgaagtgagcactaaaaaatacattagtctctttaacagtgtagaaaacaaaaagtagagttacaaaccattattacaataggagcttttataatcactcatatgtatacttttattgagatcttcaagtaaccagcttttcatttcaccctgaaaaactcccttacgacttccaaaatttctaacaagaaatatgccagtaatcttattgaggatctggtgtatgtgatgagtcacttctgtcttgctgttttcaagattttccctttgtccttatacttgtcttccaaaacttcgattatgatgtgtcttggtgtgggtctctttgagttcactttacctggagttcattgagcttcttggatatttatagtcatgtctttcatcaaacttgaagagttttcaggtgttatttcttcaaatattttctctctcctctctttctgggactcctccaatgcatatattactcagcctgttggtgtcccataggtctctaagactctgttcacttttctttaattttttttctttctggtccttggacttgataattgccattgtcttatcttcaagtttatgggttctttcttctacctcctcaaatctgcctttgaatcactctagaagagttttcattccagttattgtaattttaagctcatgaatttctttttggtttatttttaggtattctctctctttgctgacatttccattttgttcatacataatttgtttttacttttcccacatcttcctttagttctttgagcaactttgacagttatttttagtctttttcttatatatcttccaccaggtcttttttaagagtagttgcctttatttttcctttgaataggccaacttttctgtttctttgtatgccttgtgattttattgttgttgttgaaaactggatatttaatttaacttttatttggccagtcccatggcatgcagaaattccacagccagggacagaacctgtgccaccacagcaacccaagccactgcagggacaacaccagatctttaacacattaggccaccagggaactctaaaaactggatattttaatctaatattgttgtaactctagaaagcagattaccctccttcccctgtggtttattgtctttttttgttattgttgttattgttttcacttattatttttgcttttttcattgttgttggctgtctctgtgccaagaatcaatctaacttgtaaacttaaggtcttttgaagttgtttctgagcctttccctgggtatgcatggtcacttagtaattttccccttatatgtattgtttttaaatgtcctagtctttattttatttatttatttatttatttatttttgtctttttgccttttctagggttgctcccacagcatatgtaggttcccaggctaggggtctaattggagctgtagctgctggcctacaccacagccacagcaatgtgggatccgagccgcatctgcaacctacaccacagctcatggcaatgccggatcctttaatccactgagaaaggccagggaccaaacctgcaacctcatgtttcctagtcggattcgttaaccactgcgccactgcaggaactccgatgtcctagtcttttattttattttatttgtgtctttttgctatttctttgggccgctcctgcagcatatggaggttcccaggccaggggttgaatcaaagctgtagccactggcctacgccagagccacagcaacgcgggatctgagccgcatctgcaacctacaccacagctcatggcaacgccggatcgttaacccactgagcaagggcagggactgaacccgcaacctcatgattcctagtcggattcgttaaccactgctccacgacgggaactcccatgtcctagtctttaatatctggtctcaaaaggggaaaaagtagaatgaagggagtgataataggtgttaatcctttaagtcctatggaagtcacttcaactggaggaggaggggcttgcaataatgggggaaggtgcaacagcaatggatggctgcctctttgtctgcacctctgtgataagaagctgaaatgagcagtcagagtatagatacacactatttggaggacagggtcattttttcccaccctggattccacaaactatgtgtaagtcattcccgggacacatgcataactgtctgccaaataactgaaaggggggagaggggtgactggtactgtgttaagagctgaagtggattgcaattagccttaatttaccattcaagcttcctcctggaaatttcaagccttcagtagaccccaaagttccaaaatacttacatcagataattctgccagtgcaattattgtctaggtaaaaagacagattcctggtacttcctactcccaccatattaccagaatcctcttctcctggaaatcccttaaaagtcccaatacccactcataccaattgaatcagaatctctgggggaagttctcattgtggctcagtgggttaagaacccaacagagtatctgaggttgtgggtttggccagtgatgctgtggctgtggcataggctccagctgctgctcacactcgacccctggcccaggaacttccatgtgctaaaggtgcagctgtaaaaagaaaaataaagaatctctggggttgaaaccaggcatcagtattagttctccaggtaatttcaggatgcagccaagcttgagaaccagtacgttatgtctcctacaactagagagaggtataactcctatgtgatatttggattttggaggcagtgctctacatatgagggtatccaactacctcccacttatctgataagcataaaagtggtgagattccagtagaaccctgaacaagaggaagctctccagctggtccaagttgtgggcaagttgccctgccacttgactcttctgaccaatcatatcttacatagttaaaaaggtctgaagtagactgggacgatggatgaagactgttgctagctttggtagaaaacaatagcagaggccaagagagttctggagtaaggaaatgcccattgatcaggtgactataattccttccttttaaagaggaatttctgtaacttttctcttttttccttctcactcactactgactcttgtgtatatgggtgtgaactaaatttatcatttatttcacagattgaaaaatagtcaaatgggctttctaaggaacccaaggagaaatagttattatctgaagatagcagaccctgagaagcctgaccctctgacattatctctggattctggagtctggtattagcagagggggctgagctagagagttgtgcatgatattttgcatcatggtagcatagactattttagatatgtggaaaaaattgattgacagccagacagttgtaagtgaatgtagtaaagacttagaggcaactacccagctcataacagtatgtccttctctgagaactccccatagtctaatcctaataaactatcttttattttaccccatgtcatagctgctgggaggatgagtggatgctgtgccatttgaattttcttttttcaagaatctagagttttgaatctggagatatttgaagctgggtcacatttgcagacctttagggaaagtttgcattttttagtctttgaagcccttgaacttcccttgctcttgcttgtggcctggtggtagtgatatgctgataaatctttataaaaccacctcttttttttttttttttggtctttttagggtcacacctgcagcatttagaatttcccaggctaggggttgaatcaaaattgtagccactggcctatgccacagccatggcaatgccagatccaagctgcttctgcaacctacactgcagcttgcaacaatgagggatccttaacccactgagtgaggccagggattaaactcacatcctcatgaatactagttgggttcttcacaacgagccacaacaagaactccacagccacctccttaaaaagaaggatagaagggaaagggaaggaaaggggggcctgatttctagtgttttcagattcccatggtgtaaatactcttgctgtggttgatatcaagctattatagagaagtcactgaacaaagagttggcaagcattttgtataacaagttctcacaagcgggtacgaagccagcttcagaatactcctggctgactgtcaactctcccttgtattcagtagaactctctcgtagcctcccagtaatccctcttgtgggtttagacagctcaagaggaatgtctgttctaagcaaccaaaatatcttcaaccaaaatacctagctattataactatcttttattctgaatagttgcaatcaatttactaaaaatgtgttccaactttggctggtttttcacacagccacatatattaaatatttacagctatattcatttacatgcaagattcctatctatttctacaaatgtgcagtttttgccaggtccaggaaagagtgtttttaatcatagcagtcccttgagatgtgttagctttggaaattcctgccctctagtgtccagtgtgaggaactactttagtcttagctatgaatgttacaagaggattaagaagaggtgagttcaaagtctttgacacccatcagggacaattctctggctatagacaggtgggtattatgcaaaggaattttgcaccaggttctcaaactcatcatgattgacattttaagccagacaattcttggttgtgagggctgtcctgtacgttgtaggatgtttaacagcatccctggcctctatccactatatgtgagtggcaacctctccacaagttgtgacaaccaacaatatcttaaggcactgccaaatgtccctggggacagcacagggcatgggcatgcagtggtggtgatggtgcaaaaatcatcctgggtgagaaccacctctctactctaatggaataaatttgtcccatgcatcactgaccttaagtagcactgaacccagtaggctatagtaccaggttagagcctgatgttcagactgagactcttgaattcccacactgtgtactataggagaaataattccaggtgccagagagagaggcatccgctttgtaataggacagagtccacaatcaaaacttttttttttttttcccagatttcccgttgtggctcagtggtaatgaatctgactagcatccatgaggacacaggtttgatccctggcctcactcagtgggttaaggatccggtgttgctgtgagctgtggtataggttgcagatgcagctcagatctggcgttgctgtggctgtggtgtaggccggcagctacagctctgattcgaccgctagcctgggaatttccatatgccctaaaaagaccaaaaaaaaattgttttttcgttaaagagagcacttatgaggcattccaggagtggatgtgatgattcattcattcatccatcttatagataatttgttaagcagcatctctgagacaagtgacataatgggtgctagaacttatgcaaaggcagactaggttctgcctttaaggaactaaccattttagagggttcaatggggatgttttcagttataagagaaactctgattccaagtgacctgataatagaactttattggctcacacatttgaaaagcccacaggcagtgcaggcttatttttgcagccatggctcagggttgtcataaggactgcagttccttcagtgtccctgttcctcccaccctattgtcagttttgtcctaaggatggccttccctgtggtcaccagaggtataagcaacttctaatattacatgcttctttatttccagcaaaagacttgagattcactttgtttggactagtttaggtcacctgcccacccccaaatcaatcattgccaccaggggctggggaagtgttgactggcttagtctgggtcacttggtccaaccatggcaccagtttcaataggaatcacactgactccataaaggagacaaggcattgctgggaagagagaaggacagccacagatgctgggcattttaaatgcatagccctcaaacagccaaagccttctcctgatttttgttgcttctcatacaagctctgctatgagatttcatccaggcgcatggctttggcaccatttatgtgggtctccatgaaagtcttatcacagtcctctgtgctttgcatctgctgctccaccctctgaaacctcatgccatctccactcctaacagtgatccccttctcttctctcaaagctcaattcacctctgaagacatccttccctcctctgtacacccttggcccttgaacttccttgggcctcgtattgttcaggtttcaatggactgcttctctagtgggctctaggatgagtttagccccaccttctgcttctcaacaattttggtctacaaagttctctctctttaatgcctaatataagaattgtgggcttttggtggtgatgccttgctgtcctcagatttcaaaagcaagatggttaagtgtgtgtgtgtgtgtgtgtgtgtgtgtggtgcacgcacatatgtgaaagatagagtaagggaatcagacaggagctgtgggaaaagcaaagaatttagaatcagacagtcttgggtttgaatcctgctctgcacctttatagatgtgaggctttgaccaatggatcctcacttaactctgctttctgtccttaaaaagtatgcattgtatgttaaatattcacactttcacacttgagagcatgctaccatgcctgtgttattctttacataaggtacatttaataaatacttgtaaccgtaagtgttgctgaagctatggttcccttatcagtaaaacacatgatgactttggctgagagagataaaaaatgggcaaaagtcagctcttctagccttaaagacacttctcctcctccagctcatgggccccccagagtataaggaggaggtgtgccttgtcccttctacccacccccttgtccgaatgccctctgaggcactgccttggcataacagcttatgtgtgcccatgtggctcagagcagccttatgggcacaatgtcaaattgagaataatcagtcatgtatttatttttacaggatccattttaactaatttaatgcagttggggcagatttagtgcataaaaagtgggagatgatgcaggcttaggaacatgtctaatttttaaaatattcttttttttttgccatttctagggctgctcctgcagcatatggagattcccaggctaggggtctaattggagctgtagccaccggcctatgccacagccacagcaacgcgggatccgagccgcgtctgcaacctacatcacagctcatggcaacgccagatccttaacccactgagcaaggccagggattgaacccgcaaccttatagttcctagtcggattcgttaaccactgtgccacatgggaactcctaaaatattaattcttatggcaaaaattcccctttattagattcttctatgaagcagcattctccttgataggaaacctggctgtccatatgtatggtgtcaacacatttatcctcatctgcttctctggtgtgagcttccctcagatgcttcccaggtgagtggcttaacctttctgggcctcactttgctcatctacagaatgggaataatcctctactatgagggaagcatgccctgttgtctatcccatgcaccacacatcagcctgctctgcttcaaactatttattacaaatacacccgccctgtctcgctggaaatccagcaagtctctcccaggtttcccttggccatatacattccccagagttcaggactagtaaccaacagatttggctatggcattgttttctccctctgcccttgtgccccaccctgaccttcaagccttattctactagttcttccactggcagttagttacttcagtgcatcactttgggaagctctacataaacatttgttgtgataaaagtgagtgaatctcagagttcctgtcctggtgcaaagggattagtggaaactctgcagtgccaggaagcaggtttgatctcctgcctggtgtaaattgggttaaaggatgtggcattgctgcagctgcagtggaagtttcaacttcgacttagatctgatccatactgcagcttggatctgatatctggcctgggaactccatatgctgcggggcagctgggaaaggggaaaaaaagttagtgaatctcaatcatgttctttctttcttttcttcttcttcttcttttttttttttttttttttttttttttgtcttttcatcttttctagggctgcacccttggcatatggaggttcccaggctaggggtcgaatcgaagctgtagctgcaggcctacgccagagccacagcaatgtgggatccgagccacgtctgcgacctacaccacagctcacggcaacgccagatcgttaacccactgagcaaggccaaggattgaacccgaaacctcatggttcctagtcagattcgttaaccactgcgccacgacgggaagtccaatcatgttctttctatctttgtgccagcagacacatttttaggacatgagaactttgatggggggtggggggtggagtctaggtatttaaaaattctgtaaatgacagttctgaacatctttgggagaaaagccacaatccatgaccagaccagaatatactgagaaaataatttatttaattttaaatcaggaatttttattttttaatattgaactattaataagatcttgaatttgtccatttgaaatttaaatttaaatgatttttttttaaaaaatcaagattccttcaaaaggaaatatcagtccttttctttaatctttgagaacgaatcatttctgtagtttggaacttgcaccatgaagtctctgcactccagaatggattccataaacttgcgttatagagaaacaagagtcctaattgacttgtgatttcctttttcttttacaagactacttctccaggatttttgttgagttattttgttgggttattttgttgagttattttgctgggttgcaaaaatttttagcaagaattgaagagtaggaggcccagggaaacagtagagaaaatgtaggtttcattttatcaaagaagcccatcgtgctgaacatcaagtcagtgcaatggctcttcaagtaaatcatttgaaaatggacacaaatgacctaaactggaacacaagcaaaagtatatcacatacctgcagatgtaaatattgcctcctaacttcctttacaccaaactgcttaactttaaattacatgtaagatctcatagcttttcttagagaaagggattgaaaagctgtttagtcatgaggactgggtctcccattgccatcctctctactttgatataaaatcaattaaccactttattaaacatgtccggcagttacacttcagtagtgcagctggggcaggggaaatgagaggttccctgataagcaggcttttcctctagtccactccttgacggtggctctcaagttgcccatgatgggctgagggactctgagagttagagcaggtggcagcaggacttgctgatgcctgattgtcatgaagccaagatctaggaagtcacttcaacccactgtaggcctctgtccactctgacatcatccacttcctctgagcaaggatttgtagacacaaattccagagtctggcagactgaatatgacttggccaaagcaagaagcatcttctaagacagtgctgctctagttgtcatatggttgaggaggctggagccactctcattgcctcccattcagtgcctggatccaagctgtatgtacatgccaactccatgccctgtgtctcttagaaatggcattgccccacagtgatcagccccctctctttccaatctgtcttcgctatttcatggcaaacttacttagaagctgtgcttttatttcgtgctgagctcccattggttcattcggattccctgtaactcccaacattcaccattgggaatcttgatcagtatctgcgcagaagccaaacaaaaccctgatgcgaaaaggacatggacttcaaataacctgaagtcctctgctgttgaaatcatctgaggattgctaaggtagactctgatctcctgctgcaaagcaactctgttgctttagacttagcagagacaggaagacgctaaaatcaagaggacgacccctcccaatcttattttgttgccaaacacttccctttgcatacttttctccagtatgacatgtagagtgtctctgactttttctttgcctatgacaatttttttttttggttcagttaatagtatataccccctcaacccagaacagataagaaatcattgggaatttacatctgattactacagagtcattctcccatttgacaaggctcaaagttgcaaggaagaataatatgtacttactgtgttggtattttgttagtatttttttaaaagttaaaattaagtgctacttctctgaggaagtagccagagtaatactctttcaaattcagaaaactgctggcacaatttaaagtcagatgttatttctaaccaaattatactcttttttctgccaagctatcttgacaatcctaatatccacagacatgcctatatgataatcccagcagtattctggggataagattttagtgggtttgttgagaaggaaatacttgtttagatggctttcatcatgccactcggcttctatgtcattttccttgtcctggaggattcccttgaagcactcctgagtgatgtttagaacctgagtgggtgttcccccaaaaatggctgcgtggtaataaaaatccccctggccaaacggaatgtaggctgcggactccttccgcctctcgtaggtgaactcgtcaggatgtgccttgtaccaccaggcctgtagctgagccaccgactggcccagggtctccaccccaaagttgttttggaagacctgatccacgtccatgcagaagaggaagtccacctcgtgctggatgtgggccaggatgtgctccccgatggtcttcatgcgcatcatgctgatgtcttgccacctcttctcggacttgatctcaaacactttaaaggaacgcagaggacccagctctatcaaaggcatcctggagatatcatccaccatgatgtaaaagatgactttgtggccaaccatgaagtatgtatttgcagatattaagaactcctccaagtaatgctcaatgtatctgaaataaagaagaatggggtaaatgtaacctctgggatttctagaggagacaatatgctattatcatctagtctgtattttgcagtttaggaaaggaatgatttttccccatcctggatgagagacgtctgttgctgtaacattcccagctactctccaccattcagtcattcagctttggggaggtggagtggcttacctgactggtgattctggcagggtggctgggcatgctcagccctgctccttcctctctcactcttggaagccaaccaggcagagagaacatgtgttttcagctgctctgggccttgcagtggtaccttagtggcacaggccctgctcccacatccagaggcctgcagttacttgtgctgtatgtgcctggatgcctaagtctttctaattctgtggttcaagatttggaagcccagggcctgcagttataagccacatactccaacaccagctttaactgtaatgaaggtgataactcattaccatctgccttaattagtctttatccccttgtccttatcaatcagttcagatgctagttcttccttttttcctgcattattcagatataactgacatatatcattgtgtaagtttaaggtgtgcaaagtgttgatgtgatgcacttatttttaatttttattttttgtctttttagggccacatccgcagcatatggaggttcccagactaggggtctaattgcagttgcagctgctggcccatgccacagccacagcaacaccagatctgagctttgtctatgacctacaccgcagctggtggcaatgcttgatcctttaacccactgagcaaggccagggatcgaacccaaatcctcatggttactagtcagattcttaacccactgagtgacaacggaaactccctggtacactcatatattagaaatgattaccactgtggcattacttgacaccttcatcatatcacataattaccatttttttgtggcaagaagacttaggacttattctctgaccaaccttaaagtatatattacagtatgattaaaaacaatcaccatgctgtacattagatcccagagcttattcatcttataactgcaagtttgtaccctttgattaccatcagggggcactagttcttagctcttcctcaaaaaccccagcctatattccaatacttttactgacctaccagatgcaagcgtgatgtgcaagggtcattaagcctaaccatcgccactctcttatccttctctgggacccaaacaatggattatggaatatggatattcttccatcttactgatttaccctgtgagtttcccgctggtcaccccaaacaccagcccattatccagacaccatcattataaaacccatccaaatatgagagcaaacgacctctgattcaaccttactttaactatctcgtttcatttaaaaaaatagattttagtttttagaacatgtttaggctcacagcaaaattgagctgaaagtgcagaattccccccgctccccccactcccactcccagcttctcccaccatcaacatccagcaccagggtagcacgtgttgcaactgatgaaactacactgacacatcattatcacaccaagcccgtagtttacactaaggttcactcttggtggcagactttctatgaatctgaacaaatgtaaaatgacatttatctatcactatgtatggtaccatacagagtattttcactgccctaaaaaatcctgtgttctgtctattcatccattctcccacaccatcgcctggcatctactgatatttttactgtctccatggatcagtacctttgaccttttccagaatgtcatatagttggaaccatatagtaggtagtctttgcagatggtttcttggtaacgaacatttgaggttcctccatgtcttttcatggattgatttttttttttaaagcactgctaatactccactgtctgaatgtgctacaatttatcaattaatttgcctactaaaggacctgttacttccaagttttgggcaattatgaataaaagtgctataaacggagttcctttcgtggctcagtggtcaacaaacccacctagttgcaggttcaatccctggcctcgctcagggggttaaggatccagtgtggccatgagctgtggtgtaggtcgcagatgtggctcagatctcgggttactgtggctgtggcataggccggcagctgtagctctgattcaacccttagcctgggaacctccatatgccgcaggtgtggcccaaaaaaaacaaaaaaagaaaaaaccaaaacccaccccccccaaaaaaaaatacctgctataaacatctgtatgcaagtttttgtgtagacataaagtttcagcttttgagggtaaatactaaggtgtgccatcgctggattgtatggtaagagtatgtttagttttgtaagaatctgccaaactgtcttacaaattggttgtatcatttcgcattgccagcagcagtgaataagctttcctatcgctctacattttcatcagcagctggtattgtcagtgtttgggatttgggtcattctaatagatgtgtagtggtattttagctatttacctattcattcaaaaaccatcatgttcaggaagaaaaggaaaggggggagttcccattgtggcagtggcacagtgggttaaagatccagtgttgctgcagctatggagaaggtcacagctgtggctcagaacttccatacgccacaggtgcagctgaaaaagaaaaagagaaaaaaaaaaacccatcacattcctgtcttctgtaagccaagatacaggctattctgtgaagccatggggatgatagagaagggaagaagtagttggctggcttaacacaacccacgtcaccacccagactcatgcccagtgactgtgcactgaatttaatttgttgatcacattatcagccaatgatgacattttgtaataatgactggcacttccttttgttttttggttgctgcttggattccctttgattactacaaacataaactgtgctttcaatgctggtctctggaaaccccaggtttatagtattgattctttaaacggagagaatatctcagcaatacaaggagggacttcaacatggctctggggctaatggccaggaaattcttctgcactctggaactttaagaaaaaatctattgtgccctgaagcttgggaggtgatcctaggggcgagggaggaaacctttgtgaggtttaacattgtttagagattaaagcgctgcagttggtgctgtgcactgtcatttgaaaataaaccaaacatcacacctcctaaaagtccaaatccactcttgggaggatttattgctgctgagtacaaacagtcctcactcgcctcagagcagagtgcgcgggtttcaccaggacatgccaagtacagtttagttctctaaagctgcaacaagatggctagagccaatgtggagccgttctttttggaaacaccaaggttaaatcaatctgcagtatggctggctggtctcctcttataccaaaggattaggtgagctgggaatctttcccaactcctaacagaacatattcttctagtcgaaaggtcaaaactccagagtcacccttctctattagagatgccacccaggcccctgggatcagtacattcagggacattaggacttgattagtacagtgacagtgataccttctgggctctaggttggagaaggtctcaggaggacgcttaaatcttcactcagatcaaccttgaccttcacttctctttgtacaggcaacaggtcaactaacttcttttcttttcttttcttttctttctttctttctttctttctttctttctttctttctttctttctttctttctttctttctttctttctttctttccttccttccttccttccttccttccttccttccttccttccttccttctttctttctttcttcctttctttctttctttcttcctttctttcttcctttcttcctttctccctttctctctttctctctttctctttctctttcccttccttccttttctttcttccttccttccttcctttcctgcttttttagggctgcaccctcccaggctaggggtccaatcgaagctgtgatgatggcctgcgtcagagccacagcaatgcgggattcgaaatgcatctgtgaccacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttcttctctttcggatttttttttaagtttggtgaaagtatagtgtcttacaatgttgtgataatttttctgtatacaaagtgatttcagtttctttgtggcttcagaaaaggtacagatggaaaggcccatggatgtgggggagggaaggggcacggaggtgaacaggaaaattgaacttttgcttttgttttggaaaaaaagggggggggattctctaaaaaagaaaactgggttatattttaaacgaacattacagctactacttttaagtaagaatgtttacagtttggggagaaaagttccaaacaaggaaacgggggctgaaacaggaacctatccaacctctggaagaggaagttctgagcagcctaatctccccgggccaaaccctccaggaggaataggcagaaggcacagaggagtggtcagccatgcggacgtggaaaaccactccacttaggacacttctgtctttggtccttggtctggggtctcgagagcataggagaaacgacgcacacacaggccatctaacaattgccatttttggaatttccacagagggccgtggaggtcagggcggaggtggctgtgggtgtactgtcgactctgggtgcagtgggtatagcagatcttcttccctgcaacccaagcccctcaccctgaggtgggaaagagttgaccctctgactagttttattcttagcctttggggacctcagcagaagggagtctaaaatggccctgtgacaccattctcctctccactaattcagacatgacatgaacagcctctgtaaacccaggggcccctcacccatcctctgatagtggaaggggaaaaactcaaggccagttttattagcaacacctaccttccgacagcaaaaaccgtcaagcccacggtaattttctgtttggcataataattatctaagacggctctgttgtaagtgccttcccataccactggagccttccatctggttatggtcacgacctctgggcgtttcctggtgacaaaacatagagtcaggatggctttgctaaggtacgacagtctgggggaacatgggtcagtcatggcttgtggtgactggccttgaatcctgactgtattttagccccagtcagctggtggtgtgacattgcagcatcttctgggggagggacaggaggctctggcccaggtgcctctgcgggctgccctggtggcccctttggggatcgtacctgtacaacgtgtatgtaccttccgtccccctgttctgctgtcctcgtcctcaatcttccttccaaaccccttcgcctatctccccaggcccttcctaagctgccagcgacatctttgggtgttgcttatcccagtgggtgccacctgaccctgagaaagccctatggcttgactagcgggatgagagagtgacatttgagctgaaagaggaagaagctgtctcagtttgccttctgccagaaagcaatttctgggtaggaacctggttatcggacaaaaagggccccagactaaggggacctggtgttgtggttcattttacgaagaaggagacagtcacccagaaaagaagggacccggcgggctaactgtggccatgggtgacacacagggctcgggctcagacctctctcagatcatgtcacctcttgactagaagcacaaaagcgggaggggagggggcatgttctctgcacccagaacacttgaaagggacttagcaaagccaacacaaacacaggaagccacggaagagcaacggacaaattgtaaagagtaaatgcgggaagtctgggtagcagctggggccccccagaggcaggagggagctgagaagacttggctcaaaccccatttgctctggaagtggctgcacttccccgtcggaaacagactgaaacgtggtcatttagattcaacccccaacacaacatgagagggcctggcccctgctagctgtgtgcttgtatttcagccactgcagggagaaggccagtggttggggcaacgtcttgggggtcccatcgggcccctgctggctgcctgggtatggccctggtgaggctgtctaggagatgttagcccagcgagaacatacccccaccctcatacgcgggtggaggaagggttttcacaaacctgcccctcccccatgggagaaaccatgtttccctgcgagattgggcaaggctgggtcacccccacttcttgctcatgccttctgtccctcgtcaccaagctctgcacccgtattctggagctgcctctgccctcccacccccaccccatgccctgcttcaagcctgcttccttcctcccctaagagtaattctgcagagatggaggggacatggctaggctgctcaaaccccacacccccagctctgccttcacaccccaggtatgaccgccccttggggacacctgctcttggtttccaacaatcatgaaagaagctgttttggactctgtaccaacttgtgccaggtactttcacatacactttctctcatttagtccttgcaaaagcttggccatgtagtatgctcaatgtacagatatgaaaatcaaggctcaggaaggcttgttaacttgaccaaggccaaacagcagatgatggtaactaacacacactggctccttcctatgggaccaggcacagtgccaagagcttcacccttttgtgggggtggggttgctatattttgattcccattttatctgtgaggaaactgtagcacagagtggtgaaataacttgtctgaggtcacacagctagtaaggagccaagctgggatttgaacccagatagtctgactgtggtctgtgctctgaaccactaccctctatggcttcttggctatttacttgctgtaccaatgaactggagttaaaacccaggtatgtcatcatttccactcatttgagctacttcagcatttttatcagggcagaataaaaaaaaatgatgagctttttttttgtttgttttgttttgtttttagaaacttatgtgatgcttttctcacataaaagccccagctttgttgaatgactggatttcaaaccaaaaaaaccacacacacacacacacacacacacacacacacacacacacacacacagcttaggcttatcattctataaccgtttcccatgcactgtcacttcattcattcctgtccttagtgtagcctgtcaaggatctcttagcagttcagaccccagcctatcagttaagccatgcagctgtgtgtgagctgaacatctggcaagcaggcaatattatctttaagcaaagaaaaggaagagaaagagaaggaggaagaggaggaaaggaaggtattcttatttactagtcgcaagcactggggttaagtaccggacttttattctctcattgaatccttacaaccacgttcaagagtgggtgctatcatcacctccatttcacaaataaagaaagtcgggggtgagagagaaggaaactatgtttttagccattcaaccaataggaggggccacaccagggcatcacctcctcgatgcacatctgccaagtccctgctccatctgccggggcccagggctaaagacggagatcagacccatcctaccccttgagaacttcccatccctgacaggtggtcagcctgccgcacactcctcagccgcacaacccctcagactacaccttctagaaagaccgattcagaacaccagtgtccagtttggttacttggctgggaagattccttttaagcaggggggagaaaaagtagcaatattaaaaattaacgtcgaattaaaaattaaaatgctctatttcccagctgttaattattaaattccactggcaattccaacatgtcagcaaccctgactaggaagccatatgacaggctgaaaacactggccgtgggcaggaggaggaggtgggaggatgattgagatcagcttcctggatgaacctctgctcaaaccccacccccaccccggcccacagaaaaagaagaagtaacagcaggcaggccaagtatgtgtaagagcaagagctgcccaacgtcatcaagagagggctcgaaaaggagggaaaagtccaggaaacactggaaactgctcagttttttaagccgggcacccactgcgttacttcggcatgtggggttccaccagtgcaaaccaaagacttccacaaaataaaagggtctccaaaatccaaacgcaccacctacctaggtagttggtagcttttcaattttatgtacttatttatgggtacactgtggtcctgaagggctgggcagaggaagtgttaaaattctatgaatcatacagcaggtggaaaaaaatgaggaatgcaacaatgtgttacttactggattccttccaggcagcaggacgtacacagtgatccagcaaagagctaatgatgccatggacaagggtgatggagagagggagatgacgtgggaagaatgaacagaacatgtagatgaattagactgtgggctggatgaaggaaggatgaacagtgaatcatggaggtctcctgactcttgcttgagatgggaaatgagaagaatgagggtggggtggaatcaaaaactccctctgggagttcccgtcatggctcagtgggaacaaatctgactagcatccatgaggatgcaggttcgacccctggccttgctcagtgggttaaggatctggcgttaccgtgagctgtggtgtaggtcacagacacggcttggatctggtgttgctgtggctacagtgcaggccggcagctagagctccaattcaacccctagcctgggaaactccctatgcctcaggtacggcctaaaaagacaaaaaacaaaaaaacaaacaaaaaaacccaaactccatctgagtcatgcgagacctgcagtgatgtcaggcaagagttagacacaactgggtgctcagagaaaacctttgggctaaagatataaatgcagtagtcattgtcccatgaatggtatctaatgccacagaaatggatgaagacagtgtataaagaaaagagatgaggataatggactcaacctccagaaactctaacacttcctggctgagaagagggaggggccccaatcaaggagactgacaagggagctggagaagtcggaggaaaactaagaggatgtggtgctacagaggctgagagatcttgatgtaaaaatgtatacagaatacacttaatatgtttcaggtagaatacagaggacacatttctataaatatatctataatatatttctataaatatattaattcagtggctcatctttcctgcatttatgcaagcaatttactttggtgccctgagaaggcttagattagtgctactacatatcaatattctttaaatatctgctcagcattcatttggaggagaaactgagccatgcatgggggaaagtggaaagagtgacagtgggtggctgtggtctttcacctctgaccccagtgattcagccctggctccacctctcaagtcccactcagtaaagcacaagtaccacggtcagtgtgccactctctcttgaagggagcttggtgactgtctctagctgatctatctggcccctggggagtctcacacctccccacatgcacacacatctaaggggcttatcaaagctctggtgggagttcccgtcatggcacagcagacatgaatccaactagtatccatgaggtcgccagttcgatccctggcctcactcagtgggttggggatcctgcgttgctgtggctgtggtgtaggccagctgctgcagctccgattagacccctagcctgggaacttccatatgctgcaggtgtgccccctcaaaagaaaaaaaagttatagtgcttccacattcttccacttccaggagtagcttagcattccatagatggctaccctgtgcccagctcctcaaataacacatggggaggccaaaattcccattctttcacactgacatggacctcccatcctaaaacagtaagaaacttgccagaacatactcagtccttccagagtccaagacccctcatgctggaatagatgctattctcctcggatcctcctcctacctctactgctgctcccactccgtttcagacttcttttcctccctcccctgaccctttaagtgctgatgtcagataagactcagctctgctcctctgcctggactctgatggctcctcttccaatgtctctaccacatatcttctgccagcttaaaggccctgctgtacactgacgattatgtctcccccaaattcgtgtgttgaaacccaccctcaatgtaatggtattaaggggtggggcattggggtgattagatcctgagggtggaaccctcaggaatgggatgggtgcccttagaaaagaagccctggagagctccctctccccttccatggcctaagaacacaatgagaagacgggcatgtacaaactagaaagtgggttctcaccagacaccacatctgctggtgccttgatcttggacttcccagcctccagaacggtacaaaatacatttttgttgtttataagccaccccgtctatggtattctgttacagtagtctgaaggtctaagataggctctccatgaactctatccaaatgccccacaggtacctgaatccacctacatccttaatcaagctcatcacctcccctattcctagacctgtatctcctcctccagtccctttcctggtcaacggcaccagcatgcaccagtctctcaggcctcccagtcatcccggacagcccccaccttctcactcccttccacatcctttcaagtcaggttaatcacaccgccttaccaatcttggcaaatgctagtttcacatctagtgcccctataggactgtaaacttcttgaatataagtgtattgattaatttctcctgtctgtctcctgtgcctaacacaatgtctagtaccgtgactcatagtgaaatatatcctacgtcacaaacacatgcacatacacatatggaagcaaaaatgccactaaacaatacttatccttacttcatgagatgccttctgatttcctatttggtttcaatttttgacccttaagccagtttctaaacacattaatggatcaaataatagtctgacacacatgggctagcatatcataggtgttttaatgaacattgttgtatgcttgcttagagtgtgtgcatggccttgtaaggttttttaatcatcactgccattttattttatttttatttttttagggccacaggtgcagcctatggaagttcccagtctaggggttgaatcggagctgtaattgccagtctgcaccacagccacagcaacaccagatctgagcctcgtctttgacctacaccacagcttgcagcaatgccagatccttaacccactgagtggggccggggatagaatggatactagttgggtttgtttccactgaaccacaatgggaactcgcgtcattgccattttacagaggagttaaccgaacctaagaattttctttatctgattctagattctgtggctttccacagcaccccatgggctataggacctctcctagccccagtatttttttgctttttaggggctgcacccgcagcatatggaggttcccaggctaggggtcaaactggagctacagctgccggcctaccacagcaacgccagatccgagccacgtctgcaacctacaccaccggtcatggcaacgcgggatccttagcccactgagtgaggccagggatccaacgtgaaacctcacagttcctagttggactcatttccgctgtgccaccacgggaactgctagccccagtattttgtgattcatctgttgccattggctaattgctgtcagaatcactatgttgttgcgcaaacatttgagtcaaaacatccagactccccacctcccgggatgccacgccagtcactcacacacacacacacacacacacaaaatccggaccctgttttaagggtctaatagatgctaaaactctgtctcccctgtcgggaatgttctcatggccctgttgcctacacagcccctgccacctcctgctgagctgtggatttactgaaatagggcaacgcttcttttcttactcaggattaaaccagtccactagcggaagctctcctctgttgtcttcttttctttgttccttttcgttgcctatagcgtcttcttcttcgtggtaactgtgagtcctacgtacaaacggaaaacaagctgaggaaggcagggagggtgacccatgtgccagaatgagagtgaggatcttgtgaaaacagattccaaggcagagaacacgtgcgccaagcaaatgtctacagaaggcttgtgatactaaacatttattcgtaaagacgtccgtctgatgaaaaggttcagtgctcccctttttcatcatccttccagaccagcacagttagcaatgtaatgacccagcaattctcaggttctgtcaggagcagggaaacctgataaaacagtccttatcagcgtatgtaagctcatgacagcctttcctgcagcctcaacttcagcctgagcctcactcactcccacatcaaatgggaaaaaacaaaaccttgaaaaccaaacttaatgcccatccccaccacgcaacagagtccttgcatgattccaataagccagaaggacgaggcgactgagaaggtcatggctgtgaaaccattttatttggactctacagccttgagcagatacacagatggccgtttcccagtcttacccattgttaaaccagctcggaaaccaccagcccctctgagcactgctgccaacttctgggtttctaagaaatgaaaaagatgacaaacattttttagaaaatgaggcagtcccaaactggggcagggggtggggggtgttccaaactctttttatggcagatcacttaaaatcattttttaaaaaatcactaattcgtaaaatgaacagaaatgaagctgctccagctgaatgactgaggatggacccgacactccccagatctcccctcccttgggtggcccccggcactccgctggtccagggagccctcgcaggaagagaaggggagaagaagaatgacaagggggagggcactaatccataaatccaagtcctggatctgcccctttcctgttgtgtaaccctgataggacatttttcctctctgaatcgccattgcctcctctggaaagttagagaacaatgacagcaccaaacctaccatgaagatggatggcttcgaagactaaacaaagtagcctacgtaaaagagctttataagctgaaaattactgtagtaagttgtagtcttaaaaaagaaaagcccacatttccaagaatgatctcttgctaaatgaggagaactggagttgctacaaaggtcagcagtgacagattcaggaaacctgagggtttctaaacccgaagctcagcaaactgtaatcagaagccgtttttctccacacacatgctcagatgtccacactcactgtgagagtctctccaaggcgtggaccgtctagaggagggacaagagggggaaagccaggagctgccatgccctttggttggacaaatgaggtggtgaggcaggaataggcatagtagtaagaaacttactttattttactttattattttattttttttgtttttttagggccgcacccgtggcatatggaggttcccaggctaggggtctaattggagctgtagctgccggcctacgccacagccacagcaacttggaatctgagccgcctctgtgacctacaccacaggtcacagcagcaccagatccttaacccactgagcaaggccagggatcgaagatgcatcctcatggatactagtcagatttgtttgcactgcgccacaactggaagtccaagaaacttaaagtccatctactttcaggaagtgcttgaaatggcttatgaagaaagtgtggttacgataaataggaaaacaatacaagaatcaaaacaaaacaaaacgaaacagagaaacattttagtcactcgggtgttttcacatgactttggtcatcccagccactctgtgagaacaaaatctttaactttatttttacttcatagctaagatattggcaaaatgagtttgagcaaattgccaagatcccatggcatctaacaaaagccaggatttaacaccaggggataaatcatatcagatgaaggctactataaatcagctatactttaataagaaaaaatgttttaaaaaaaatgaaggccaaggaaaatgcaagcatttaagcacaatactttgctctaagcttcctagcaaccaagtcgaagataggaaaaaaaaaaaagaaaaatgaaggcttagagtccttaatcaccagtaatagtaataataataaataataataatacacacactagtttatcaggacacccagcctttcttcctaatcctttgtcttggcaaaatttctggcaagggtctttataccacatgtagtaggtagcataatggataatatctactctgattcttttttatgagcaaggcaggaatgttctccaaacaacatcacttaaagagatagatacttgatgagaagcaaaggaaaaacacaactcatgctctagaaaggcaagtctaggggctggagaagtacagctcagacccctggaaccccatccctctcctccacctaggaccacaagtgtgtcaccacctgccatgttaagaatggactgtagggccaccagggtcacatggaaggtgacctagagatatctggaattcaaagcacttactttgactggtatatccagaacaaagaaccttctgggctaaaagcaaatggaaataaaaacatatcatgttacttggaatgcagagaaaagctattttgcaatcattatcattgaaaccctaggctgagctgagagcctgggttgtggctactcccaggtttccaccttcgagatcgaaaaaatgatatcacgggactctcgtcatttcagaattactcagatcaaacggtgggagggaggtctctggaaaatatcaaatcttagtttaaagaaaaaaaaaatagatggcagctcttattgtccaaggtggctttgctgagggagagaggctccagagatgggtcccaggaagaccacagcccacccatccctcacccaggatttatcttcctccagaaaaacaggtcttgcctcgctggctcaaagctgtctacagagtagcctcaaagggcacttctaggagttcctgctgtggcatagtgggttaagaatctgactgcaggagttcccatcatggctcagtggttaacgaatccaactaagaaccatgaggttgcgggttcaatccctggcctcgctcagcgggttaaggatccagcgttgccgtgagctgtggtgtaggtcacagacaaggcttggatcctgtgttgctgtggccgtggtttaggccggcgtctacagctctgattcgacacctagcctgggaacctccatatgccgcacctagaaaaggcaaaaagccaaaaaaaaaaaaaaaaaaaaaaaagaaaagaaagaaagaaaggcagaaaaagaatctgactgccgtggcttgggtcgctgtagatgcacaggtatgatccctggcccagcacagtgggttaaaagatgtggtgttgccgcaactgcagctcaggttgcacctgtggcttggattcaatccctgacccaggaatttccttctttctttctttctttcttccttccttcgtggaatttctatatgccatgggtgtggccattaaaaaaaaaaaaaaaaaaggtacttcttaagctaacaaaagcagtgagaccatcctacaagacgggatcagtaaatatatgacgactctagcagaccgcctccattcattcaacaaatacctgctgagcatgcgttacatgtcaagtgccagacatacagtgttgactgaaacagacaccatgtgtctgtggtgtagagaagctggcagggagggtggaccctattttgataaacacatcattataggacttcaaaactccaagaaagcataggagcacttaacaggaagacctcgaaggctccccaggggaggggatgatgttttagctgagttctgaaggatacataggaggcccagtgaagagggattagcaagagtgtgcctaacagagagaaaaacatgcaaaggccccaagaaaggaaggtcgcatatttatttatttattcatttatcttttggggttgcacctgcggcatgtggaagttcccaggctaggggttgaattggagctacagctgctagcctacaccacagccacagcaatgccagatctgagctgtgtctgtgacctacaccacaactcacggcaatgccggatccttaactcactgagtgagtccagggatggaacctgcatcctcatggatactagtcagattcgtttccactgcgccacatcggaaacgcctgccctcatctcttaaaacagaaacaaaaaaccactaaccactaatatttgtttgagattctgccaaagccccgatctcctccctctgccttctgccccagctgggagtccacatctcctggtaggaatgaaatacatgccttcctaccacctatggtttcccctctaagctcagtacccatggacccagctctaaagtcccttgtttctaaatctgtctattgatctgataatattcataatagctaatagttggctggggacctttctaagcaactgacatgtattagctcattaaattctaataacagtcaatgaaggaggttctattcctcctcagagggacagaggcaataaattattttgcccaaggtcatactgctaagggaagaaacagtatttgaacctggggaatctgacttcagatcctacaagagggggaagggaaaggggcaagaggagggggagggcccgtgccacccagcactcaggagccccaccctcctgccgaggcactcagggcatcaatttatagatttggatttgccacctcgtcccatctttttagtaacccctccctcttcctcatctcaccctcctttcccagaagccttcaacacctcaggtcacagcaacaaccaccctgaagtgtacggcatttaacacatattcatccttcaaggcacagctcggatgccatctcttctgagccttctttggtatgaacctagcacaatgcctggcatacagtaggtgctcaataaatatttctaaatgagggagttcccgtcgtggcgcagtgcttaacgaatctgactaggaaccatgaggttgcaggttcggtccctgcccttgctcagtgggttaacgatctggcgttgccgtgagctgtggtgaaggttgcagacgtggctcagatcctgcgttgctgtggctctggcataggctggtggctgcggctccaattagacccctagcctgggaacctccatatgcctcgggagcagcccaagaagtagcaaaaagacccccccccaaaaaaataaatgcaaaacatagatccatctccaagccaaacataatcttgccctccctgaactctcacgttcctttgctctctctctctgacatcctccttctagcctgtgttgttgggctttcatgggtacctctgcctgctccatctacagcataaccccttgagggtagggattctccttggcgcacactgtacccctcgcagcatttggcatgaacaaccagctccagaaggagccccagatgatgaatcagaagatctgagttctaattagaagttagacataagttcactgttaaggcatttcacctacttgtccatcgcctgaacaatggaaaccttgactaaaggaagggttacccaggttacccaagtcagacagccctggacctaaatcttcctaaaaatgtgaccttgaacgttcacatttaatattgtggaaactcagtattcctcatctagaaatgtggactaacactgaccttccagggctgttttaaaaacaggagggaatgaacagtggagttcctggcacaagcaaacactcaataactagtagccgctaacatcaaaatcaccatcaccatcattactttattatagctcttaaagtttcttccacctctaaaattctaagcttgtggctcagtggcttaagaacccaactagcatccatgagaatgtgggttcaattcctggcctcactcagtggattaaggatccagtgtttgccatgagctgtggtgtaggtcacagacggggcttggatctggcgtggctatggctgtggtgtaggcagctctgattccacccctagcccaggcatttccataggccacaggtctggccctaaaaagaaaaaataaataaataaaattctaagatttttttttttttttcatctagcctttaaccaaatgctgtcctggatgacattcttaaacagctgtatgtgtttgatggagttattttgtaaatctctttttttttttttttcaagggccttacctacagcacatggaagttcccaggctaggggtcaaatcagagctgaagctgccagcctacaccacagccacagcaacaccggatacctgacccactgagcgaggccagggatcgaacctgaatcctcatggatactagttggatttgttaccactaagccacaacaggaactcctgtaatcctctttagctacagtgctacccacctgtctaaggttagtgccctcagctcacctcagaccaattcacaaggtggcaaagaatctcctgccttttaaaccccttgcagatgttcaaatagattcctcacattgaagaatgatgtggctgcagtctgggtgccagactacggccctgaagagcagccagaatctgctccagttactgtgaagagagagtgtgcccagcactgcaaaacaaccctctttatgggaggccagcaccaatatgcacttctgggcctttggcttctgtgttttaattttgtgaagtacccaaaatatggaagtataactctggctgcaattcaaaacaatcaagagttcagagcttgaaggttgcctacacaagcatctcaactcaggtcaggaaccccatggggaacttgctcttctgttagattctttcagcccctagaattttttctttttctttttcttttttctttgtagggccaaacctgtggcatacggaaattcccaggctaggggtagaatccgagctacagctgccagcttacaccacagccatagcaactccagatcctagccatgtctgcaatctacaccacagctcatggcaacactggatccttaacccactgagcgaggcgcgggattgaacccgaaatctcctagttcctagttggattcatttcccctgcaccacaacgggaactcctagaactcttccttctatttgccaaaatctcctgtcctatgctgccctccggacagatggtgatagtggtggtggtgatggcagccagcgcttactaagtacgttgcccttagtgctttattcacaacttattttatccaacaaccctatgaagcaggtactactatcatccccatttttaaagatagggaaacttgcccaaagtcacagaggagggaagtggtggcacaggaccaaccccaggcagcctagctccagcctccactgagaatatctcctcagtcctcaagtacctaagggagccccagggtctctgcatccaacgctgtcatcttttcttcagaggaagtaccacagtttcctcaattcgaaaaggttggtttgtagacatttgttcactctctagctcgtcttgtttttcttaaaatgagttcttcagaatgagagggaataactgttccagaagtggttagatctatgaagcatccaaaggaatgacagcttcttattctagggaatccacctcctcctttttttttttttttttttttttttttggctgcacctgcagcatgcagaaattcctgggccagggatcaaagccaagccatagcagtcacctgagctgctgtagggacaagactgaattcttgaacccgctgagctaagagagaactccctagagaatcctccttctactgatggacctgaagatgcagttcctttctaagtggccaaaatggtcctgctggctcatcaagtcttagaatttaagagacattctaacgttaatccaggccatcatcctgaacttgaggggctactaaaacactacccatcaaaatatcaatggtgatgacatagctctccaggccaagttgttttttggttttttgtttgtttgttgtcttttttccttttagggccacacctgtggcatatggaggttcccagactaggggtccaagtggagctgtagctgccggcctacaccaaagccacagcaacaccagatccaagctgcgtctgcaatctacaccacagcttacttcaacacccgatccttaagccactgagcaaggccagggattgaacccacaacctcggggttcctagtcagattcattttccgctgcaccaccacgggaatgccttcaggccaagttgtaaggtggcctttttgaaagaaagtccaagcggtatcaatacctcttaagtcaaagccatcatgcattttggtagctgcttgcagacatttctttctgtcagaagcgtctccagctggaatctccaaggcatcgtagtttccaaaagcaaagaagcagcgtcaaatatttggggtgaatccactgatgaatttgaaaactcagaaatgtttaattcattttgctttccagagttaaaaaaaaaagacaaaacacccaaaagtttagccaggcacaaatgaatcaccagcgactcagtgtgttttgcagcaaaagtcaacaacttgagttgttcctttaaactctgcaaatattttaggattgcaaaaatcagggtgtatttctcatggaattcctgtctgaaagttctcaaggtaacttccatatctggtcatataaataatttaatattatatcttggtcttaacatgaccttattatttctggctctagcctacccagaactgcagaggtataaaaatcaggacaatggcaacatggcaggaaggaagataattaattagctggaaggtacttgaagatctaatgactttaaagacggtatttaagggctcagggatacaggaagggtagaatattttctttctttctttgctttttagggccgcaagtgtgggatatggaagttcccaggctaggggtcaaactggagctgaagccaccagcctacgccacagccacagcaatgccagatccgagctgcatctgcaacctacaccacaggtcacggcaatgccggatccttaagccaaagagcaaggccagggatcaaacccacctcctcttggatcctaattgggtttgctgcccctgagccacaacggcaactctctggaatgctttctttacggtgtcagtgaatcctacttttaatgcaagctggtgacttggctgataactaggagattagaggagactttcatcaacatcatttcatcatgtttcataattacctgttgatgtattcccaaaacacaaccattacagttgagacaagcagcattgacagaaccactcttcctttgacattcattattttctcctgggaaaagaaaaggagaagggaaaattagattaaatacacccagagtggaatatggttttttaagaagtgcttataccaatatcttttctaaaaggaaaagttgatgaatagtcaacgagcgctaaggagtgcgttctaccttaatttgcataggcctacactggcaaattagccaagtcaatgaactgacagggccgtctgggttgggaaggatactaaggccattttgaggctcaaaggggaagcatcctgactgatcccaaggtccaccgagatgtgggagagtgacgggtttagttaatggtccctaagggctccagccgcccccaactcagatgccccacctcgcatcacagactagaggaagcatccgtttcctaggtctactgtccctgatatactgactatgtaccttatcctcaaagaaaaatataccctggtcctttatttaatttcatttaaattttagggccacactcacagcatatagagattcccaggctaggggtcgaatcagagctgtagccactagcctatgccacagccacagccacactaagtccacgccttgtctgcgaactacaccacaactcacggacagcaacgccagatccttaacccactgattgaggccagggatcaaaccttcgtcctcatggatgctagtcagattcatttcagctgagccacaatgggaactctcaccctggtcctttataatctaggctctgccacttcccacccagcttttccccaatgcacccacacaagtggcaaacagtcggtacattcgtatttcttgatcgctgcatgaaattgtagttgaagagggaagggatgctgggtggaataacaggttgcggagtactttaatttgggtggagatagaaagatatttatttcaaatggaaaggacaagaaaagtgtggcagctagccacatatcagcaatactcataaacaaagaatgtaacaaaagataaagtagggcattacataataacaaagggatcaataccagaggaagacataacattggttaacatatatgcacacgatatcagagcacctacatctagaacgcaaatattaacagacataaaaggaaaacttgcacaattacataatactagtagaggactgattcgcaacattttgtgggtcttgtgatttttttctttttaggtctatttgtctttttagggccgctcccgcggcatatggaggttcccaggctaggggtcgaatcggagctgtagccaccggcctacaccagagccacagcaacgcgggatccaagcctcattggctacctacaccacagctcacggcaacaccggatccttaacccactgagcaagggcaggaattgaacctgcaacctcatggttcctagtcggattcgtttccactgtgccgtgacgggaacgccaacattttgtgttttagatgtcatagtttacatcttcacagctatccttcaactatataatttagtcttttaacatctgtactagtttatttaagtgtttgatgcaacaccttcactatatatttgacttttctagtcttattatttcctttctgtattttctcatatcttgttacagttttttctttttcatttaatgaagacacaaacatttcttgcaagtcagtgtagtagttggaaactcagtttttccttctgggaaactctttagtcacccttcaatttggggagatgactttagagcttcccaagggatgaagataggatgggaaaggatgacaagggccgtgagaagggatgagaatattttggaaacagcatctataccaggcagacaagagaaagagctgctcgtgtttgaaaaaaacaaaagcaaaaaacctggacaagaaaaaaatagtgactgacactgtcccccttgagtggctggtgctaggcagtcagaaggggggcagaggcagtcagaacctggaaaggtatggaaagtagggtggggaatcccaaaaagcatctaaagctggagaatcccctgatccaacttcacctagagagacccatctgggtgctgagtgtggagaatggagaaaaggacaagggcagaccgttctcatgaccataaagaggaggtggcctggctcaaagggtggcttgattcaaaatatactttgggagttcccgtcgtggcgcagtggttaacgaatccgactaggaaccatgaggttgcgggttcggtccctgcccttgctcagtgggttaaggatccagcgttgccgtgagctgtggtgtaggttgcagacgcggctcggatcccgcgttgctgtggctctggcgtaggccggtggctacagctccgattcaactcctagcctgggaacctccatatgccgcgggagcggcccaagtaatagcaacaacaacaacaacaacaacaacaaaaaaaaaaaagacaaaagacaaaaagacaaagaaaaataaaatatatactttgacaaataccatatgatatcacttataactggaatctaatatccagcacaaatgaccatctccacagaaaagaaaatcatggacttggagaatagacttgtggctgcccgacaggagagggagggagtgggagggatcgggagcttggggttatcagatacaacttagatttacaaggagatcctgctgagtagcattgagaactatgtctagatactcatattgcaacggaacaaagggtggggggaaaatatacatgtaagaataacttgatccccatgctgtacagcgggaaaaaattaaaaaaaaatatatatatatatactttggagagagaattgataggacgtggttggtaattttgttatcagagatgagacaaggaagacccaagatttctgcttaagcaggggggttgtagtattttctcagatgggctggaggaggaacaggcttggaggataataatcatgaattcccttttggacgtgtgaatgtcggggagtgtgcgaatacctaaaaggggacagggagacaagtggacattcaagtctaaagttcatcagagagatgtaggcagaccatgcaatcggagaagttgttcatggaccaaggaacgtatcggatctgacgtgaagggaacgaatttgattacccaggagagaatgcagagagagaaagaggaagaggaggatgctgggctgaagctttagaggtaggatagaggagggcccagaaggagaggaccagaaggtagcagagacagaagagtggacacctgggagccaatgtcactgcctttgtgaagccacttcccacccccaccctgaccacggctgaagcccttttctctcctccggcccccatccctctattcctttgctgtacacatcgccctgggagtcggctcaccggataagacctgcattttgctctgcctcctctacctgcttgtttgagcttcctgagggcaggagggatgacttcttcgtcacccctgaattcccagtgccccacagagagcagagaaggccgtcaataaataatgagtggtttgagcttcctgagggcaggagggatgacttcttgatcacccctgaattcccagtgccccacagagagcagagaaggccgtcaataaataatgtgtgggagttcccgttgtggctctgtggttaacgaatctgactaggaaacatgaggttgtgggttccatccctggccttgctcagtggcttaaggatccggcgttgccgtgagctgtggtgtaggttgcagacgcggctcagatcccgtgtggctctggctctggcgtaggcctgcagctacggctccaattagacccttagcctgggaacctccatatgccgcaggactggcccaagaaatggcaaaaagacaaaaaaaaaaaaaaaaaaaaaaaaatgacgtgtgaatgaaatgagaatggcactgagatgtgtcctttcaggggacgggttattctccaaatatttgcagagagggttctgaggtgactccaggcttagatctcaggtgctccatcacctctgttgtgaaatccagttaaagaagagaaagtatgggattatcagccatgtcactctattccttcttgcttggaaagtgagctctgtttggaaacctctgattcaatcgccacctttcggatacaatcatgataggtggtgttccagagacggtgagaagatggggagatggagcttctttcctgtgagcacctcaggtcctggcacaaacagcccggggcccagggcaaagttacgaaatgcacggggctacatgcagctcggcccagatgctggaaaaagccacttgactcctacaccaacagcattagcactgagtgcgaggaaaggcctgggtttgggagcagacagatcggggtggagactgtggccactgtggccatgcctctctgccgttgtcttcactcccagagaagtgtgggtggtgagagagcttgggaaggaggtggggtctggagacacccacagactgggtaaccctgaacatggagcagtttctcagaccctcatccaactccaagctctgaaaaccaaaagcctgtttataattcagttggcatccaggccctgacacgaggctatttataatctttatcacttagtgagactgtttaaacatttctttgcataaatattgatgtacattgttatgtgctgttgctgcactggaggcgttacataatataggataaatattctgcatttgaaaaattctaaattccaacatatctggccttaggcattcaggaaagggatggtggacctctaattgatcacattagatgggtctcctcatctttaaaatgggaattaaaatggtgatgactgcaagagatggtgtccataaaatatttagcatcatgcccagcatcatataaaagctcaaaaactgctagtttgtattactggtatccataaaacaggctgttgggaggatccagtgaagacagcacagcgcctggtacttagcaagagctcaaaacgtatcggagggaaaggaataagcattttggaataagaatgtgttaaacaataaagtacaaattgatgcaaattagggcctctaaaggtttatccatctgttctatgctgcagactgactaaaagctcctgggaaatgccacgcaactttgattttctttgatcaagcccaggccatccaaagccttgtcatccccacctgctgaggatcaaaccctgtgtaagaaatgcgaaagagagaaacacaaactcctggcagagaacggatcagggagaagctggtataaaatcagacacacctcctaatcctttctccaaaggcaagtgtttttctgtttgttttggtttcagggtttgtttgggtttttttgttttttggtttcttttggtctttttaaggccacactgggagttcccctcctagctcagaggttaacaaacctgacttgtatctgtgaccattcaggttcgatccctggacccgctcaatgggttaaggatccagtgttgccatggctgtggtgtaggtcgcagatgcggcttggatccagcattgctgttgctgtggcgtaggctggtaactacagctctgattcaacccctagcctgggaacctccatatgccaagcatgtggcacttaaaagattaaaaaaaaaaaaaattaaggccacacccaaggcatatggaagttcccaggttagaggtcaaactggagctatagcttctggcctatgccacagccacagcaacgccagattcaagctgagtctgtgacctccaccacaactcatcacaacatcagatccttaatccgctgagtagggccagggattgaacccttgtcctcacggatactagtagggctcattaccactgagccacaatgggaactcctttgtttcatttgtttttgatttttttttttttttttttttggtcttttctagggccgcatccacggcttatggaggttcccaggcaacgccgcatccttaactcactgaacgaggccagggatcaaacccgccacatcacggttcctagtcggattcgttaaccactgagccatgacaggaactcctgtttttttaatttcagaaattagcatcagagacaactcttgaagcccccccccccttttcttttcctctggaccgtaaacatggcttgaatctgcttacttttcgctgtggccaggcatcactcttagagacttacagttggaagccacccaaatgagccaatattgcctccttttgaaaagcactgggaaggggtatatgcaagctttctggaatctggaaccctagtgtctcaggaaagaagggttgccagaatggccaaagggtttttaaaacattttttttttttctctggattaaaatgaggcatttggcagcccatgtggtctaaagcccttcacggatgtgtttgtcacagaattttctaactctctaattctcaagattggtggttgactatcttacccaccaaataggaaaagtgggggttgcttctacatttctcatggaagagggagagcacaggattagagcctagagagcactagcaccctgtcttataagggagagtgtaaccacctcagcaccacctgggccccagccctcagaggatcaggtgaacccagcgggcccagttccacctgagccctcccaccatcccacaggccctcctgccaaggcgtttgccatttctctctgctcctgggccactcccacaactcagcccctgcagcggtttccaaaagaaaccacttgcacccccactcccgggcctcgtgcagactgtgctaaaacccagtgcatttcccaaggcagggccacgctggaaagcctgtcatttctccaccttcctcctcctcctcctcctcctcttcggcttctccatccctggggtatcagactcttccccaaggcccataaattaatccttcctgacccacccctaacttgtcccacacagaacggtacacacaccccctccacttcagagaagctcatggtttcaccgcaactggtccaagtcaaggttttccttccagacagagttccactctgaaaggaattctagtggccctgtttttctccacctcgtgtcagggggaaaggtgagcacctcagctgaatcacagagctctcagaagccctggaaaagccattatcttgagagagcagcgagcaagcagtgacagaggaaaccaaagcttccagcagactaaagaatcttcctctctgcctgtgactcttgccctgcccctggaacccatcctgccctgctagctccacaggaccctggcaagggtcaagaaagtcaggtagtgataagtgcagcaaatgaaacacagtgcgggggagggagccaaggtggggaagccgcaggaactgactgggtgttactcaccctggacaaaaacctcctatttttaggcctaacatttagatccagcattccaggcagaaattaggccggtgctgggactggaatctgcagccctacatgcacttgccctgggcaagtcctctggctctgagcctctacttacacagaccaaacggagcttcaaacaccctcctccagggctcttgaaaggacaaaaggagaccccgtctatgaagcatgttgtgcctgatgctcagtaaatgctccacaaatgcagccagaacaagggcgatgctttttacggggagagattcagaaatgtgtggctctgacggccgagctgtggctctgtctgagaggagtctgggccctccagggcagcaccacacagaagggtccagggcgagccccccacgctgttgtgactgttgttggggccagctcagggtccccaagcgcatctcgtttgcctctatcgcctggcgcgcatgttgggcagggaaggaaagtcaggctccagggtcaccccagcacccacacagagcgggtttgtgaaccacacgcagctttctctggcctcagtctccccgtcctttgaaacatgtcctgtgggcttaacttccctgaatgagccaagacctgtatgagaaggcagccacagagctggaaggctccttttatgaggacaggttcactggagctcaacttgctgcagtggccacagattcctagaagtggtgatcaaaagataggattgccagagtttccgtcatgacgcaacggaaatgaatctgactaggaaccatgaggttgcgggttcgatccctggcctcgctcagtgggttaaggatccggcattgccatgagctgtggtgtaggtcacagacgcggcttggatcctgtgttgctgtggctgtggtgtaggctggcagctgtagctccgatttgacccctagccaggaaacttctatatgcagcgggtacggccctaaaaagcaaaaaataaaaaaataaaaataaaaaaagagataggattgcccacaaaatgtgttgagccctcaggccacttcacccagaagcctccgggtcaggcccccaggcaggcctggggtgtggagtgggcaaggcccaaatgcttcctccaggtgaggtgctgcccctgcctgggggaatcgttccagcctgggtgcctgtcctggggctgcaggtggagcccaggtactgaccctgctccccgcacctacctgggtcctaggagcaacctgccccatccaggtagaccttgctgagctccttggagcctctcactttgatcccaaggagaaggagctgaacatgatgctacttggctccctgctcacaggtcacgatccagacctcacaatcacctggtggtgcaccccccactccagccaggatcaaagagctgaattctccaggactctggctggacccacctgagcaagaaactgccaaaagatggggcgtttgaaggacctggagcacctacacaccccaagctttcctcatggtttcagttacaagatctgtgtttggagacctccccttgggggcagggaccatggaaaagttccagctgcaagcagaccagctgggagtggaaatcatctcctcgggctgcaccatcacggccctggaggtcaaagacaggcaaggcagagcctcagatgtggtgcttggctttgctgaattggaagggtacctccaaaagcatccctactttggagcagtggttggcagggtggcaaagcaaattgccaaaggaacatcacgttggatgggaaggagtataagctggccaacagcctgcacagaggagtcagaggatttgataaggtcctctggaccccttgggtgctctcaaatggcatcaagttctcgagggtcagtccagatggtgagttaaaagtctgggtgacatacacgctagatggcagggagctcatggtcaactctcaagcacaggccagtcggaccgccccagtcaatctgaccagccattcttatttcaacctcgtgggccagggttccccgaatatatatgaccatgaagtcactatagaagctgatgcttttttgcctgcagatgaaaacctaatccctacaggagaagttgctccaatgcaaggagctgcatttgatctgaggaaaccagcagagcttggaaaacacctgcaggagttccacatcaatggctttgaccacacgttccgtctgaagggatctaaagaaaagcaatttcgtgtacgggtccatcatgctggaagcgggagggtactggaagtgtataccacccagcctgggatccagttttacacgggcaacttcctgggtggcacgctgaaaggccagactggagcagtctgtcccaagcactctggtttctgcctcgagacccagaactggcccgatacagtcaatcagccccacttcccgtctgtgagttcaaacacaccccttggttctagttttctgtggcctaaggaaatgtaaagatatgacctgttccagggtcaggctggaagccccttcaggaacctgtctcctacgcagagataagatgaagatttagaggttttaaaagtgatcctgtgtattactcagccattaaaaggaaagaaagaacggcatttttagcaacagggatggacctagaaattatcatgctaagtgaagtcagtcagacaatgagacaccaacatcaaatgctatcacttacatgtggaatctgaaaaaaggacacaatgaacttctttgcagaacagatactgactcagagactttgaaaaacgtatgctttccaaatgagacaggttgaggggtggggggatgcactggggttttgggatgatcatgctataaaattgcattgggatgactgttgtacatctataaatgtagtaaaactcattaagtaataaagaaaagaatgtaaaaaaattaagaaacagaaaaaaaagtgatcctgtgaattaaaattacacaaatggtagttgtcatgataatctgaatattgatttctttcacaatgactggctccaggccaagtctaatggtcagctctattctctgtgtagtgaaaaagacccaaccatcaatgtcatcttctaagccctgaccctaatccagaagtggtacccagatccttgtgttggctctgtctctccactctgcttcttttcactccttctttctttgatcctactcattcctttttcccttcctcttctacctcataccaccttgatctgtgcagcactttggagttttcagaggtcactgagctcattcaacctggtggtagagggacctctctgcctcagtaaaagaatagatgatgaagtgagccacctgagaattaggggaggtaaatgacccacctaaaggcgcacagccaggaaaaatttagcctggattcaagatcaggtcatgcaaattcaagtccttctttgcctccacttcagtcttccagagcattcctggagtcattaatgggaaaagggggggtctgacccttactctgttaaagccagaccttctttccagatatcacttttataagaagccctagtcagagtttaaatgtatctctgagccttataaatagtgtgacttaaaatacaagatctaaatatccagaaaaaaaaaatctgtgaatttgattctccgcctttggggttactaagaaagcccagcctagccaagacatgggaaggaagccgctggagacaagagctgtgtgagttcgaggagagggccttgctgggactgcacgctgcaccgagagcagactgtatttggtatacgaggcggagttccctcctctcctaaacaattgaatcacgagtgatgggtttgtgttgatggtttttaaagaaatgttatcttatactcctctacactaataatcagttgaaataaaaccaaaatgtgcaccctcagaaaaaaaaaaaaagaataaaaagaaactgccaaaagactgacagcactaataacaagttatgaagctgaaagaagcttctcaaaactcccaggaataaaaagcaaccactgattaaccatgctagaggcagaactgatttgtcttcctttttgtctctcttaaaaatgatactacaggagttcccgtcatggcacagcggaaacaaatccaactaggaaccatgaggttgcgagttcaatccctagcctcgctcagtgggttaaggagccagggttgctgtgatctatggtaggtcacagacacagctcagatctggcgttgctatggctgtggcgtaggctggcagctacaggtctgattagacccctagcctgggaacctccatatgccatgggtgtggtcctaaaaagacaaaaagaaataaaaatgatactacaaaaatcatcagataaagagatagttcaaagtatgcagccaaaatatgagaggtacatcagacagctgagtaatactaattatttttatattattttcacgtgttatggttgtttttctgaatttggtcctatttagagtattggtcagtctgtgttagctgttgggatggcacctcatattctaaatgcagtcagccttctgtatccatgggtcttacatccacaaattcaactaaccacggatggaaaatactccaaaacatcacattccagaaagttccaaaaagcaaaacttaaatttgctgcatacaggcaactatttgcgtggcatttacattgtattaggaattataagtaattgcaaggtgatttaaagtatatgggaggggagttcctccgtgggctagctggttaaggatccagtgttgtcactgctgtggcaagggttcgatccctggcccatcaacttctgtatgccatgggcaccgccaaaaaataaataaataaaatatatgggaggctgtgggttatgtgcaaatacgatgcccttttgtgtaaaggacttgagcgtcctgggatctggtatccgtggggtcctggaaccaatcccctgtggatacccaaagacgactgcattcaatccccagccaaatcatgtgtctgcaaatttgtgttcccttttcttaaagcaggccctcgatattgaataagcttcctgcagcacttggatgccccccagctgaaccagaccaggcctcaggctaaacgctttaccagaggtttctcagataagtctcacaacgtcctgtgaagtcattctagtgttatctccactttacagacatgcaaatggaagctcagaaaggtgaagtgacttgcccagtgtgtcacacagcataaagtgatggagctgatattcaggtccagagagctggcctcagggcccacccttttaactattctcagtaaacatgaagactcacccatggactaatcacccagggatctttggcacatcctctcattttgcctttcacgatgatcacttagcaattgacccaaagctagccaatcatgggctagactcagcaggggccagcttctcctcggcccagctggcgagcattggctcaactcctctgccatttccaggagcctcctgcgtgcctggtgtgagccttccccatgcacgccatcctattcacccctcatcatggtcagtgcgggggctttttagctgaggagaccgagctttagcaaaagctgagatcgctgggctcccccacaaggggggcgctgagtttgaaaagcagaccctctgcctcccaggcccagctcttggccgggggatggtgctggggggaaggagggagagtcctgctttatctaaaacctctttaaattggcttgcattacagggaaatgctccctgttggaagaaacatggtataatttggggggcaggggtggggggggagtagtgcacggaaggctgtttccagttatgtttttcattataagggtcaaagcaaacacagacgcaggaagctaagagacaagcctcagactaaacatacgaccagctgtcgctccagccatcacagacctgttctcggagggacatcttgtaggcccctttcttgaatccccttcaaaaatctgaagcctggatccagccagcttctccttgctgcctggctcagaaatcatggtgcaagagtttttccaagagaaatagggcgaggtacatgaaggatcggtgctgccctgagagggcactatgtccgcccccagcacaggtcccgggcctgagactcgtcctcctggccccacaatggcactgtgtggcccacacagagaaccccaggctgtagccacaccccgtgaggtcctgccgggcagccaacgaaagcagaaccaacagtgactgagccagcatcctgccagctcccactcctagatccgatgccggggactggaggactttgtcttctttcagaacaactggggggagcagcaagaagtcagggggagaggggggctcctctctccacgctgcagccagctcatgatacccacccccccggtgaccccagcaaagcggaggcaaatcatttcaacgtttcacgtacctcatcctctgcttctctccccccagagtaaaaggcgaagcaagttctagtgagctctgctctgcagaaggaggcagggctgggaggaagggaaggtgctgcgttccaactcctgtcaaaagaataaacagcggtttcacgaagaggagcgcagacggatcccacagcagccaggggccttgttcctccttgctcgccctgggaagtgggctgtttatcaggcctgttgactcagagctgcatgccaaggcagagacgtctctctccggcccaggatcggcccggcctccttcactaagcgaaactacaggtccaaactaggcctggtggtggaggagggacagccaccacccttgggagagacacacaggccgcccacatcacccactcctcggcgaaaatgagaaccattctgaacccaaaccaccccaaatgacaactagcagggacagccaatggagaatttaaaaagaagggggcagaaaatggagaggggtggctaaaggagagcatcctcaaaactcccgttgaaatgctaccttccgagcctcttgttcgcatcctttaggcttcagaagttgttctgtttgaacactatttttatagaatgttctgagatctcctgcatggcaagccaagctataagaacttcaaaaggtcactgaggcccaacccaactctttggctgaataatgcttaaccctccccacacccacctcctgctcccaaaatagaatttcctagctggaagagacctcacagcagtggatttgtaaatgtcgcaacagctaaagctttaaaaaaaaaaaaaaaaaaaatgaagtcattctcagaaccccactatgtaaaacagaggacacagggggctttggctgaaggagggaaatgaagtaagtaggggctcagagcccccccacccattcttcccaagtggccccagacacttcctgggagtagagcctagaaaccccagactaaggagaaggggccgaaacctgacagaaaggagccaagaactgccccctcagcttccagcggatggatgcctaatttagcttctcactcctgttctggggaagaaattcaccgccccctcctctggggcatgagctagttgaccacagtcttcaagatctgcttaataaactactgaaatcctccctgctggcatctactaaagctgaaccaaccacacctcatgttccagtcattccgccccagattaatacctgaaagcaagtgcatttaagttcaaacagagacgtgacctgggaccaaaagctggaaaaaccccaaggcccatcatcagccagatcaggtgtggtccaggtgagggtcacacacatccgtgagaaggaaccagccacagctgctgacatcaacagggtaaatctcacacatggtactgagtcaaagcagccctggatgcttgcatttatttaacgttcaaaaatagacaaaaccgggagttcccgtcgtggcgcagtggttaacgaatccgactaagaaccatgaggttgcgggttcggtccctggccttgctcagtgggttaagggatctggcgttgccgtgagctgtggtgtaggttgcagactcggctcggatcccacgttgctgtggctctggcgtaggctggtggctacagctccgattcgacccctagcctgggaacctccatatgccgcaagagcggcccaagaaatggcaaaaaagccaaaaaaaaaaaaaaaaaatagacaaacccagggagttcccatggtggctcagcagaaacaaatctgaccagtatctacgagaatgcaagttcgatccctggcctcactcagtgggttaaggatccagtattgccaccagctgtggtgtaggttgcagatgcggctcggatcccatgttgctgtggctgtggtgtaggccaacagccacagctccaattggacccctagcctgggaacttccatatgccccaagtgtagccctaaaaagacaaaaaaaaaaaaaaaaaagacaaaaccaatctgtggtgccagaagtcagagtgggagtggtagagactgggaaggggaggctcagagagctgctgggggagggggggggcttgtcatgttgtttctcgagccaggtagtggttatgcaggtgtgtccaccttgggaaaatgcctcacaaacattccctttcagtgtgtgtgttaaaaacaaagatgcacagaaatcttcctgctggaagctgccttctcttgggaattctgacttcccctgagtctacagggtctcagggccacagggtcatggatagaccccgttttttccttctcttgggttcaacgccccaataccaagcaccacagagcacctaagtacggactcagggaagatctttcacattaaatgatgcaggcagctggactgtggtcaactgggagggaaagttcacagcatttggaggctcaggaactgggctaagataaactggtcctttcaagaagcaagcacccaggagttcccatcgtggctcagtggttaacaaatctgactaggaaccatgaggttgcgggtccaatccctggcctcgctcagtgggttaaggatccagtgttgccgtgaactgcggtgtaggttgcagacgcggctcagatcccacgttgctgtggctctggcgtaggctggcagctacagctccaacttgacccctagcctgctgggaacctccatatgctgcaggagcggccctagaaaaggcaaaaagacaaaaaaacaaaacaacaacaacaaaaaaaagcaagcacccatcatggttgccaccttccagtttacaaagcagcctctctcctttaactcagcaaatcctcaggctcacccgccccgggtcagggaagggagggaggcactgggagcctctgtgacttgctcaaagttgccggctggtgggtctgatgctgcccttcctcctgagctgcctctggggaacaccctacaggttcgtggaattagaggctccaggctcatgaatcagagcacgacagagtatgcaaacttggaaggcagaaaattcaacttccagaggatccgacatgaccttcctccttctccgacataccctgatgcccagactctcaaaacaaggaagcatgtacttccggtcattccttcatggagaggcagggaactgtagcaagtgagcctcaggtctgctgatcaaaggaggccagtggccatccaggtaggagtttggcacgtttcccagcccagccaggccgactaatctcatcactcaatgttccccaaggccccttccagccctaacagtccataggcctgtcagatgacagccagcattcagagcctgtccatctgccatgtcccctgcagaggagtgcagggccttggagctgcggctcagcagctgcagcccaggtgtgaagggtcccggcttcatgccccagaccccttccacctgagaaacacaaaggtccggattcccaccctgtgggagagggagaattaagtgttcttggcaaaaagtgctacagatacaaagattgcagctgtcacttttaatcctaaatacgtttagggcaggtataagacattcttgctgtcacttgtgagtgatggagcagtttagttggtttcctcttccgtgtggtgaggataattataatccccaccgctcggggtgggtgaggggcctagagcaccgtggttatgaatgtggactctgggcccaggctgccggagttcgagtcccaggcctgcccatgtgcgatcctgggcaatgtgcttaacctctctgtgtctctgtttctatggctgcacaatgggaacaacagcagctggatggtagctggcacatggtaagtgtctagagatacgtattacccgatattgcaagaattaaggagacacgcccggaaaagtgcttgaggtgctcaatcattgtccgtctctgctgttctattaatccgaggctgcagctccttggagtttacatttgtgtatcaaatagtcattttgaccacgtaaccctgcaggtggggaaaggtacggagggaagggttcctggcacgacgtttccgttactgttaagtactgccccccacacacgcctgtgagtatcagagctgaaacgatcttggcaaaagcccacataataaataacggcagtcaagagaggttgcatctataagtctatttccttgagaagagctggaaaaatgaaatcatgatgactcttcccaggccagtacattgctaatcatcttgagatctgcctctgccccaggtaactccaggacagactccaccaaagccatgctgaagcactcctgcctctgcaagcatccatcctgagcctcagccctcctcctgcacaccaggaagtccctctctggggctcatgtcagtccttcaagctctataggtcagactcttcctagagaagaaagaagctggctttgttgacagctggggagatgtgaggcgctcccacggaagggcgaggcccgggtactgatgacaccctgggcttgagcaccagcacaggtggctggaggatttccccacccaaggaaaccgctctattcctaccctctcttggtccttctcaccccttcctcaggccaaggaccccagatggaggtgagaaagaagcacctgctccttattcacaattgggcagtaggtgccagggggtacccttgcccccgaccccccacagaagttctcactctttcctcagtagagagaacctcaaagtcaggtaagtcagctccctgcctcaaagcaggactgctttttgaacacgtgataagctcatcttccgtcaaggtcacacccacgccccgtttagagcccactgccatccacaaaagccacataacatagaggctaagtaggagaaatattacaagcccaagttataagaaagggaactgaagatcagggaagaaacttacagagtcgtatggtctgagtcagcagccctggaatggaagacaagtttggggtctttctgtgagtctgtcccacctcagcctcgtacacccctggtggtggtgaagccagaccaagctggggatgctaacggaagcagaacaagaagagggtcatgaaccagattccactagaacccaagttctttggggggtgggagggagcacttgtcttctgtcttggtcacttctgggctttcctggtacctggaacagtatttgacatctatcagacgttcagtagatatttgctgaattaatgctgagtgaaagcctacaggagccaggcaggcagcagaagtatgtgaatttgaccaggtaaggatggactgtgataaactagccaaatcagatcaaaatcagattttaaaaagaaaacaggtttcccattgtggcttagcagaaacgaatctgactagtatccatgaggtcttgggttcgatccctggcctcgctcagtgggttaaggatccagtattgccaccagctgtggtgtaggtcacagacacgtcttggatctggtgttgctgtggctgtggctgtggtgtaggccgcagctacagctccaattcaacccctagcctgggaacctccatatgccatgggtacggtccttaaaagacataaataaataaatgaaaaaagaagtacccttctttgattacagaatgtgatatactggccatagatgactcctcttttaagggaaattgttttgtgccagaagcgaaaagtattgtttgaacccttgctccccaacctaggggatgtaggcgtgtctgtcccttctctgtgcgtctgttttctcatctgtgaagtgcaaggtccctcccatttccactccatcctgcctgggcctgagtctgagggtagagttgtgaactgggctcctatagcagtctgactgggggactcagaaggcttcatggaggaggggatgtgaccagacctttccagatgggcttcccctgcctcccagggatctggcatatcagcctgcacagccactcacccttctcttccttctcactgaagacaggctgaaaaactaacctgccgggggaggcaggcagccccacacttcagaatttataaatcctcctctgctcaggctcaggcccagtccatcctgggaggtgctggaggtcattttatgaaccaaccaccttcggctttcggggcgtagggatggggcaggatgccacagaatcaccagcccactcacgagcccccctgaacccttcccagggtgacagaaaagaggaaatggagcacaattccggccccaagacaaagaaactcggccaagcaaagagaagggaaacagcttcctgagtcaggggacttggaatctgctagggccacagggaaccttccccccatcatggtgaggctgaggtgtggactcaagcaactgagaagataaggacaggtgggtccgcccccacccagctcagcccagaagcatttctttccaaagcgcccgtggaaaggagtggtttgcagtgaagaacatttttcaaaaaaatcgaagtctaatactaataatataaccagataaaagaaaggccaagaaagtgccatataaatccaaagacacggttccacaggccacgtggccacaggcacatttttcccctcctgggcctcacgccccgtgtgggcactgacggagtcgaagtggaacattcccaggacccacctgggctcggtggctgtgaagagcctgttgttacttgctctgcaaacctggctgatgaacatgcagccttcagagcgcaaggtcacctcctccaagatctgcctcctggcacaagtggattctcacagccctggtgtggcctgctggtttcacggcacctagagcgcaggttcttggacatatgtccatctcactctctgcacgcacattctcaagggcagcagggaagtctgctttaggtcaaggtccctggtggtcctcaccacagggtctggtagagaggaggtcttgaggatcagtaggctggtgacagatggacagatggacttgctggggctactgtaataaagcaccacaaagtgggtggcttaacacagcagaagtttatcctcttatacttctggaggccagaagtccaaagtcaaggtgttagcagagctggttccttctgaaggtcatgaaaaggaattctacaggcttctctcctggcttctggtggttgccagccacccttggcattccttggggcagcataacccaacaccgtctgcatcatcacacagtgttctccgtgtgtgtcagcctccaaatttccctctctttagaaggacaacagtcactggattggagcccacccgaatccagcatgacctcatcttaatttgagtcatctgacaagaatctatttccaaaaaaactcatattcataagcactggggattcggacgtgaacccattttttttttttggaagacacaattctacccactagagaccgtttcccaaatgcctattggctgggagcgtgtaaacactagcagaaccacctgtgagggtggaaacgctgcatataattacggagttgaaagcgaaagtttggaggcaggcggggaggtaggggtggtcttgagaaagaggaaaacatcttagagcatctctacttggccaggattataggaagaagagaaatgcctccccgggacaggcatctgtgggatgtcccgccgaaatgctgccggtctgtcaatactcagctctgggcatcacagagccatgaatgggtaagcttcctcccaagaggagcaggatgtgaaagaagagggggccctggggcagctggaaccaagaacctatggaagcacagagctgggcaccagattgcagtgggtcaaggaatgaaggtcaggtgagaaagtgacgtgcaaggacctctcgccagcagcttgccttgggaagggctggagggagggtgccagctagagacacatggagcaaaaaggaaatacccttgagtacactgctgataatgaaaagcccttaatgagacagagccgaggagaggagggtttgaagattcagaggagggagaggatgggggctgaagagcatctcttggcggggagatgggggtgccaccaagacaggctgaaagtgctccccctttttgaaaggagcaggagacagaatgggtgggttggcaagtctggggataaagcgggtaggtgacaggctccaatccagagcagctgaagcgaggagggagaagggggccaggaggcagagaagctggagagctgtgcagaatctcatcaccaggaaccttgaacttgcacctgaaaaatgggcatttcatcctgaaagtactagagaatccttgaatgccactaggcaaagaaagttacacgatttgctttttagaagacttccttggctgaaggatgagggagcccagccaggaggctgctggccaatgtcagaggaaagagtagagacctaaccccacaggtagagctggaagacaagaaagaagtggcatcttgagacatagggttacatctatcttactttctttctttcatttttttttttttttttgctttttagggccacacccacagcacatgcaagttcccaggctaggggttgaatcgaaactgtagctgccagcccacgccacagccacaacaatgccaaagccgcatcttcgacctacactacagctcacggcaacgccagatacttaacccaccgagcaaggctggggatcgaacccgcaacctcaaggttactagtcggattcctgagccacaataggaactaccgggtcacgtctttgaaaatctgcttcagtgttactttagagaaactgtcctggatttaaaattactttccttttgtagttatctatctttcaattttatttcttcttctaccagagtgtcaactctgtgggcagatatttttgtgcgtttggtacctgtgtggaaacatctgtctattacagcccctggtgctccgtacagctttgtaggctaaaatgcatgcctggtacagtgcttggcacctgtgtgttcaataaacatgaactatggtgataacaacagcaagaataacagtgagcaatgggatgaagggagtgaggcagaaatgagactagtttggtgggactcaaagtgtggactgagcaaccggtagcatcagcatcacctgggagcttgttaagaaatgcagagcagcaggcccacagcccaggaacctgtgtctgcatgaggtctgcaggtggtctgggaatggggctggttcccaggtttctggttgaaggaggagagtgggtggcatcgctgctgactgacatggagcggcggggctgagaggagggggagtcagtgagttctgctcaagaggtgctgagtttgaagaacctgcagaagtcaattcagcaatgttgtcccagagagagagcccggggagagcccagtttcggagctgccagcccagcgtgcaggcaggagtcggcaggtcttctgtgtgccaagggaaaggagcacggagagcagaatggggcctccttaatgggcaccgccttgaaatctgaggggcagggccgagaggcaggaggagaaacaagaacaaaagttgttgctgggagaaaccccatctgaattctcagctcagctccacccgtgaccgcctctggccctgcttcccctggaagagggaaggccacggacaattgctcgggcaaggttgctgctgtttgagaatcccaaggagcgggactgtcaggcaaacagaggggtggcaacagagaggggtcccgtttccagctgtacctccaactccggcaactccctgcgtgcctggttgattcccgcccccttcggatgacaaggtggggccggggtctctgaccatgttgcctgccagctctctgggctcacccctcatgtccggccacagactctaggggaagaccccagcagagcataatggcagctgccttcagagcacgtgaggaggctccagaggccagaccaagaggtgagggaagggcacgcagggtaggaagccaggattcccgagccaacaggtgtgctctacctggctcccatcagtacagctgagagtcaaggtctaaagaagcctctctgtccctcagccaaaaagggaggcccaggaaccagcaagggccactctctgcatttatcaggtcctagtctggcgagagggacacgtgctgactgcagaccgcagctactgcagttgtgttcagtgggctggggctggcagagtggggctgcacaggtgtcccccggaggaagtcccagctcctccctgccccatcacctgttgtattttgctttaccaccctcccatttttgccatttgtgcttggccttgtcacagcaacccctcctggtgcaggtagtttcccagggcctctaaaatcaaggtgcttcccctagaacagttctgatttatacttgttatggctcaatgttttagtacctcctttcactttcaaaggtgtgcaggtgtggaggacaaatcatgttgcctgtcaccctacataaaaacggttcaataaaatagagttcgatgaagtccccttcaagacgcctctcggcttggaccctccaggagtcagggcttgtgtttaccaacagccggtgccgtgacctccccctctccagcatccttcctgctactgcctgtggtacaagaggtggtaaaagcctttctgccacccctcccctaacctgtccccttcagtgcctgttgctgggatcatctcagctccccctgcctccctgtgtaggctgggaggaattaaaagtctaagaatttactggaaaatcctaaggttgttttgtcttgggcttttttcccccctcactagatttttttcttgtaacaagttgacgagcataaaagaccttccaagaattaatctctaatcatgagagatttccttcctagtggaaagctaaaaataacaaagacaacaacaacaacaccccaaaacctcttaactgagcccacaatggagatggcttttcctctgcctgttctttgtcttttgccatttttttttttttttttaagggccgcatcagcggcatgtggaggttcccaggctaggggtctaattggagcgacagctgccggtctacaccacagaacagcaacgccagatccgagccacgtctgcgacctataccacagctcacggcaatgccagatccttaaccccctgagccaggccagggctcgaacccgcaacctcatggttcctagtcggatttgttctgctgcgccacgatgggaactcctttgcccgttcttggaaagagccaggccccagttcaaatgccagtggcgccccacccccaccccccactttcttgctgcgaagccctggctcagtcacttcacattccgagcctcagtttactcatctgttaaagagggatgataattccttactccttgaattgttgacaagatgaacagtctgtaaagctcctggtaggtacttgggaaaaaagcaacttgtattattatcgctggtccctaagagacaagcactgtccccacctcatcacagtgacaggaggcagtatgcccagagattagagcttgcacttgagcaagacaggcctgggaactgactaaatgcgtgaccttgggcaagtcactggaccttctaggacttgctttttctcctctgtaaaatgagaataacagtgactcaccatcggtgagatgacgcacatcaagcttggcatgacccctgatgttgcagcaagtgcccaatagatggtagtttctcaattcccaatagtgattattgcagaactctccacctcacaggctctggcaccacctgctctgtatctccagggtccactatgttcccctgtccccaaaacaacagcccttcctgtgcagggggcatttacaaatccacctttccccttccgctggagtctgagctgcagcccgtgagtcaggctgggtctccacgtgcggaggaggaggtggaggaggaggagtctggtaactccccaaggggggctcagctgggactggaagctgggtttgggtgcagccaagaatttcttcagccccttcctgtcccacagggagcctgattcagagttgaagggaattacgtgtttgtttatttattcattaaataaatatttaacaccagggagttcccatcctggctcagcggttagcaaacccaactagcatccatgaagacatggattccatccttggcctcgctcagtggtttaaggatctggcgttcctgtgagctgtggtgtaggttgcagatgcagctcagatcccgagttgctgtagctgtggtataggccagtggctacagctccaataagacccctagcctgggaacctccatatgctgcaggtgtggccttaaaaagacaaaagaagacccctcccccccaaaacttaacaccaatgttgatacctaccacgtgccaggcaccattcaggctgctaggtcaataaggattagcctattctgtgcctttctcacagagctagtgggaagtggagcccttcctggtgggaagctgagcccggacagcaacacttctacatcctgaagccaaggtgagtgtcctgtgacagcaatgagtcagcccctctctgggctccatggacttctggaagactcggagagcaagctcacctgcctccttgcccgtgtggctacaggaacatgtttaccacccagggtcactctctctcaagcatggccccaatcttctgagctgcctcactttccagatgagaaaactgaggcaccaaggcagggaagtaacttatccagggccacttggtgatgaggtgaagaggccagggctagtacccaggtatctggcatctctctaggctgagacgcctattagccacagcaccagaaatcaagagcttagagacggggcgaagggctgcagtcaatggtcttcttctagagttttcttattaatgcccaggaaaacctctgatgggacatagaaatgccactgggaaaaggggagcatcgtgtgtttactggagacaagtgaggcacccaattcaaaaagaagatccctctcaaacataaaatagttcagcaatggagtaaaaaacacctaaatatgtgttccacttacaaagcatcctatgggctgtgatgaagaatgtggtttggaaactccgattccaccccattgcctctgccttcacctcccaccccagtgtttagcaccaggagctcccagcacatatcacctacccttttcctggctgctgtcttcttcaatgagcttctgcttttgattcccctagagaggctggcagtttcgggcacctttttgttcctctgcttagcagttggggcggagaagaagtggctttggggtttttcttctctgggtgtggtttcctagccctcacaaaggaaagcctacagcctgctctgtctgcaccaccagcctggttgcctcagctggcagagctgattagcatgcgaggtgcagaagggaacagcctgcctggggtactcaggatactgttctactaaatgtttcctgctctccaccttcatagtaggatttcatttcctggtccccttgcagttgagtagggccatgtgactagtctgaccaataagatgtgagttggcccaagtatttaattgctggtcaaagaccctccagggctctctttctctgtgccatgaagtatattcaaggacgtaactgctccatcagcctggctccttgaatgaggagcacagcccctagctgacccacggggctcatgttaattagagtaagacataaaccgttatgggtttggccccaaagatttaggggctgtttgttactgtagcataacctacaccatcctgactgatacactgcccatctcacacagagtgagatattccctagttaagtctaccatcttcccaatgttgctctttcagccagaagccatttcacttcctctgagctccccttggcctcctgtcacacttctgttctgcactctgacttctacttttagtcccttatatataattacatacagccaatttcacattgtgagcgcctgaagagcaggaatctgtaccttatattatgatgatgataataataataataataaacagaggcagcaaatgctactatttattgaatgctgggctgggttctaagcacttgacattcattcagttctcactaagctctgagaggtcagtactggaactacccccactttacagatgaggaagcatctcagtttggttcagctgaaattgaacccctaataatatatatatatatatatatatatatatatatatatatgcattttttttttttttggtcttttcctagggccacacccgcagcatatggaggtccccaggctagggatctaatcagaactatagctgctggcctacaccacagccacagcaacaccagatctgcaacctacaccacagctcacggcaactccagatccttaaaccactgaatgaaaccagggatcaaaccggcaacttcatggttcctggtcggatttgttaaccactgagccacgacgggaactcttaatatttttttaataaatatagttcaacttaagtcattccctctataatcctagtcacttatttttcacatttaaaacattcccagaaggggtctataggctcccccagatgccaaaagagtccatggcacaataaaggttaaggtcccctgtagaagcagataccagggttacagtgacagggttctgtcccctgttctcctggaacccagagtttctggctggtggagggtaagggaccctacaccaaattcatgccacagtggggagtgaacaggagctactttattgtattcacatagcataaacataaatatcgtaggtttggcatatggaactccctgtcatgaatattttgatttcagcagtgtcagcccaagtataacattcatcacagtaaagaagtcacttgtttccccagtaaaaaaacaaaacaagggcgttcccttcatggctcagcggttaacaaacctgactaggatccgtgaggatgcaggttcgatccctagccccactcagtgggttaaggaactggcgtgtaggccggcagctgtagctccgattcaacccctagcctgggaacgtccataagtcgcaagagtggccctaaaaggcaaaaaacaaaacaaaacaaaacaattcctaacatccagtgtgctaattagaaaagcatcagctcttgatcacaaattgggataacaggacagcagccatctctggtcagtcccactcccagacgatgcatccttgagggcagatgggccgaccacccacgatgagacttgctttcttagcttctgagcactggcttggtccaagtagcactcacataatctcccatattgtatatgctgaagttttatactttattgaaccagaatttactttaaattccaggcatccaaacatatacactgaatccaggtgaatccaagcagaactctctggatttcagaaatcctgggtgattacaagactcagggataaggtagcagagccaatgctctgtgcctccttgccagctggccagtagtgagggctgagccccaggacaaccgggtggcagtctggcactgccctggtgggctggatgaccttccgcaaattacaggctcagttttcgtatcctccaaatatggagccatactagatccaagtccaggcaagaaacaatcacaaggcacccgcgctacgcctagtactgtggggaaaacagaaattacacaaactccataaggagcttacattctagttggggagccaggcctggaaacaatttaactattgtgcacgacagaaagaagtaagtatgaaggtggtggaagccccctcttgtgctctgggaccacagaggaagcacgaagccaggctgcataggcctgcgcagctcggtttcaaagaggaaggggctatgcttgaactgggcttcagagggtgagtaggagtctgatgggtgaggaagggcatacaggtggaagggcaaggatctgcaaactcggggtctggaatgggaagccccacccccagcccagatcccagcccaggggttccagtcctgctctctccacacatccgctgctttggaatctggaagagtcctggaaacctgtattttgaacaagctcccacagtcattctcacaagcaggcagtgagtgttatagattgagaaaaatgaatgaacaaatgaatgaatgaatacaaaaatgaacctgagaagttcctgttgtggctcagcagaaacgaatccgactagcatccacaaggacgcaggttcaatccctggacttgctcagtgggttaaggatctggcattgctgtgagctgtggtataggctgcaggctcagcttggatcccacgttgctgtggctgtggtggaggctttcagctgtatctctgactcaacccctagcctgggaacttccatatgctgagggtgcagccctaaaaagacaaaaaaaaaaaaaaaaaaaagaacttgacttccggtaagtccctttctctcttaggatgtccacactacattaaggagctaaagagcttcagttgtggctcagcagtatccatgaggatgcaggttcgattctgggcctcgcccagtgggttaaaggatccagtgttgctgtgagctgcagtgtaggtcacagacaaggctcagatcctgtgctgctgtggctgcagctccgatttgactcctagcctgggaacttccataggccacacctgcggcccttaaaaaagacaaaaatgaaaaaataaaaagcaaaataaaagtgctgaattggcctggtggctttcaaactgtgttccagaaaaaccccagaatctccctgaagtccctcagggacacagaggaactggggaggctgagagagccggactctgggccccatccacccttctcagattacctctccttttatctctttgctcttttttttgcaataaagggttcttggctacaaagaactcttaaagccactgaattgaataatcctagaattcccaaggagtcagagttcccattgtggctcagtggttaacaaatctgactagcatccgtgaggacgcgggtttgatccctggcctcactcagtaggttaaggatctggcgttgccgtgagctgtggtgtaggtcgcagacgcggctccgatgctgtggctgtggccagcagctacagctcctattcaacccctagcctgggaacctccatataccaccagtgcggccctagaagacaaaaaaaaaagaatccccaaggagaaatttaaaaatttcttgagggcagcagcttacctttggcaagtatgaagagagcataagggtctttttcagaagcaagttatttaatcatcacattttaaaaaccttttgctgtggcccagaaattagtgagtgaaggaaaaaagcaatgtggtataataatgcaagggaatattatgcaacctttaaagaacacttttgaggaatggttaatacaatggaaaataaagtgaggaagtcagatacaaaatttcatacagactgtgatttacggtatggattttttttttttttttttttggctacacacatgaaagttcccaggccaggaattgaacctgccacagcagtgacctgagccacagcactgacaactctggatccttaaccccctgcaccagcgctatggatcttatacatcaaaattattggacatggatgttagtaggccggtagctgcagctccgatttggacccctagcctgggaacctccatatgcctcggatgcagccctaaaaaacaaaacaaaacaaaacaaaaaaaagaagaatgcaattctgacatgtttcagcacagataaaggttgaaaacattacgctaagtgaaataagccagacacaaaaggacaaatagtgtgtgattttactgagatcaagcacccagagttgtcacattcaccgagacagaaagtagaagagcggttacgggggtgggggggatgggggtgggcagtgggaaattactgcttaagcagcacagagcttctgtctgggatgatggaaaaattcagatggttgacactggggatggctgcccaacgtgtgaatgtgcttagtggtaccgaactatgccctcaaaaagcattagaatggtttatgctatgtatcttttaccacaataaaaggggaaaaaaaagccagaactaggtgcataggttatagtggtgaatactatgcgacaagcttgtgggcagcgtggtcactttattctttgcatttctctgcatttttcaaacgtcctatgatgagcatacatttctttttaaaaccagacagaagagcgagttaattaaacaaatctcgtggttctctgacacttttgcccaaatgcgttactgtcttttgcgtaaatgtaaggtgtgttccctgtccttcgttaataaaaggagccgagcccaaggatgccaacgaaaggatacaccgaggtgctcaagtcaacgacaggcacagcggccctcctttctaagactcgttgctctcgtctatatttaataagttccaaataaaaacagaacccaaacaaatcctctaatgaacttcctaagaagctgtctggcttggaaaagctcaaaggcgaactgaagagaaagggggaacagctgctgtgtttttagggcattaactcactgcagctgggacagtgcctttgtcagtagatttctatcccttcttgcttctgggaaatgttcttgggcagaatgaattcagaaaccaggagaggctccccagtggtattccctgccaatccatctgctccagtaccctctccccaccccagaaacatgctgaacaaagatttaaagactcttggtgtgaagggcagccacgtgtctgcctgccagggtgccctccaccccaggccgcctgggtccacttgcccggctcctgggccctctgctcaggggtggcacaagggcagaaggtagctgccacgataagcagaccggggctacccctggagtggcccctccctggctacgtgacctctgcctttttcaaatgttctatgatgagcatacgtttctttttaaaaccagacagaagagcgagtaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatatggaccataccaccttcccctggccccaggttctcacctatgtgactgagggaggtggactggggcacctcttagatctctgccagctcacacatcctatgattgcatcatctcaaaaagaaaaagaaaaaccaacaatacctaaaccaaactaaaccctaaaaccaaaaccaaaagcagggtgccttctaggaatctaggccaggttcttacgtttgggggggccttggggtccctatctacaaaatgaggcacggagtttccaccatggcacagtgaaaatgaatttgactagtaaccacgaggacgcaagttcaatccatggcctcgctcagtgggttaaggatctggggttgctgtaagctgtggtgtaggtcgaagacgaggctcggatctggcgttgctgtggctgtggtgtaggccagtgcctagagctccaattggacccctagcctgggaatttccacatgccacgggtgtggcactaaaaagaccaaaaaaaaaaaaaagggaaaagaaaaaatttggcacaaccttccagctcgttccatgtccaacatctgtaattcctgaaaggaaggccccatcctccccttgccctccaccacgtcctctacctcaggccaggctcacaaacaggaaatatgacattcgagagcagcagaagcactgcttgcttctcgacagcataggggccgatggagaacaaagagtttctgagcttttccagcaacaaccagggctccatgcccaagaccttccccaagcagtgcaggcagaggacactgctgggatgggctggcctcccatgccatccccgccccggtgtgttcccaggggcccccggcagcgcagaatcagcagataagctgtctggccgtaattacacgctgatgcttgaccaaaggtggtaaaaccctaaacaggcggaaggcagggtgcaggattcctggactccagtgcaggagtggagtgaccctagagaggccctacccctctctgggcctgagtttccccatctatttttttttttttttttttttttttgtgtgagtgcgtgtgtgtgtgtgtgtatgtccccctctatttgaatgaaagggctagaatggggcctaatggcagctctttgcttgctccgaggtcttcggtttttcttttttcattccatttttttttttttttttatggccacacccacggcatatggaagttcccaggctaggggttgaattggagctacagctgccggcctacaccacagccacagcaacaccagaccccagctgccagatccctgaccatagcggatccttaaccttacaccacagcggattcttaacccactgagtgaggccagggatcaaacccgcaccctcatggatcctagtcgggtttgttacagctgagccacgacgggaacgcctgatgtcttctttctgaaggcagtgtgtggccttgatgaaaggccccatcatcttgcctgtgtctgcgtcccaaatctctccctcaccacgtgaccctgagaaactgctaaatctttctgtgtttcgtttgctcatttgtaaaactggggttgctgggtgatgaaaaggcagagctcctgtaaagctcctaggacagcttctggagttagcgcccaggaagcgtgcgctcttgctgttttatgatttctctggtttcagaatcgctccccttgccctgtttgccatctgaagaaggagcaagcatggcccagagagccatactggccctgcagtccacgtctagccctctccctccaagaaagcacatgtgaatcttggtcagccaagcacagtgggaagagggaactatgggagaaaaggcagaaaatcctacgatgctgccccacagcagatgggctcgggtgtcagctgctcccaggggttgctgggcactagagaaggcctccagctgcacccagagtcagtagcggagggagggtcctgggctcatctccagcttgatccccgaatggggaggagaatgaccccgtgggaaggagggtgatgagatgcagaagatgcagccgggtttatctctgttcctactttgccgggaccattcagggaagaggaggccacattcagtcatctcagccccgaggggaacagggaacagagaggggtgaggatgacagcactggtggtctctcccctggggacatggaggtgtggcctccctctgccacagggagggtcccaaacctgcctgtcctcagtgttctcacctgccaagggaggagacgcaaatgcctgtttccaccaggcgctctagggtctcaaattgtggctgcggacggatgcatcgaggaggcacagaaattgagagtgttttactaaaggaccagtccacaggggattagaaataaaggaagaaaggcctgatcttctaccacactgtcctaggacataaagcatgatgcgggagacaggcaggacccctgttccgcctcctggggctaccccgcttggctccagtgagctctgtggtccaggtggaattgtgggctcccatctggctgggacgactcacccagacagactgccctcctgatccgagagcatttcactcggcagcaaattcaacccacctcaaaatatcagctgcccctgatcaggcagggcctggctccctctctgccaagccccacagggctgggctgggatcagtcatggcagctcaagggaagtcacgctgcacccagaggtaaaagctgtcctggcagagaaagagaaaactgatggtcctaagaacaagcacactggctttcacccttgaggacgctcagttgagaatctcggtttgggagttcccatcgtggttgtagatggctctggtgtaggccagtggctacagctccaattagacccctagccagggaacctccatatgccgtgagtgcggccctaaaaagacaacaaaaagaatctctgtttggctgccctgtgtggcaggtatgcatttatcaggtatagagacattttacagatgaagggagcccaggggatctttgctcaaactcttttttttttttagctttttagggccacacccgtggcatatggaggttccaaggctaggagtcgaatcagagttttagctgctgccctatgccacagccacagcaatgctaaatccgagccacatctgagacctacaccacagctcacgccaaagctggatccttaacccactgggcgatgccagggatcaaacctgcaacctcagggttcctagtgagattcatctccactgagccacgatgggaactcccaaactcttttcttttacagataaagaggctcaaggaaaggagcaccttgtcgcagaagcaggatttgaaccctccaaggctcctagccccatctgcattcagcctgccaatccacggttaggagggccaactgcacacatgcgcagtgtgggatgtggtgaggaaccacacaggaaaagccctcagttctcacagagctcacattctaaacaaacaacaaaatcagtcattataattaacaaatcattaaagacataatttcaggtgggggagagggttataaagcaaatttaaaacctggcgtgtttgagagtgttttggggtgggggcagctgctgtttgggaatggcctctttgcactggatcctctcaggtcctcccaagccagtagaatgctggagctggctcctgctggcttgcaagggccacgtctcattaggaatttggcgagcaagttgttcaccacagccattattaaaaattaaattacataaacttagaactaaatgaattatagtacgacggaaggtaatcatcaaaagtcatcactccctcgggttcccaggtggcctagcagttaagggtttggtttgtccctgctgtggctcaggttcgatcccagacctgggaactttccaaggccacaggcacgtgaccaaaaagaaaaagaaaaaaaaacttcattaatttcctctttgtatgaccacatactatactcttgaagttgtttatatctattgaatctagacgtaatagatactcccagttcctccagtagtagctagaaactggtcatggtagaaatatgtctactatggaaactggcaaataccctctacgagggctttcacttttcaaagagctggtggtgaaatatttaccagcacagccttcagctctaatccaggccttctatgcctgtgggagtctgggttcttccaaggagagggtgtggtggtatagtctaactctcctggggctgggggcgaggggaggtggtgggcagtgcctccagccctgtcctcttcttcttctgtgtgtgtgtgtgtgtgtgtgtgtgtgtgtgtgtgtgtgtgtgtgtgtgtgtgtgtgtgtgcttttcagggctactccctggaaagttctcaggctacatgttaaatcgtagctgcagctgccggcctataccacagctcatgacaacactggatccttaacccactgagtgaggccaggggtcaaacctgagtcctcatggatactagtcgggttccttactgctaagccataatgggaactcgggcagtcagattcttaacccactgcaccacagcagggaccttcttcaaaagtgtttttcaacagggatctgtaagagggtgattcattccttcctttgttatttatttttgataaatgaaatcctatcataagcataccaatataaatttaaaggaaccctgccgagaatctctttgtataaatgcctgcagtcacttctgagttcccctagattttcataggtggagggacttccttagagaatataactgttctcattaacagcagactgaagttactattacctctactaataacaatgacaactgtagctgtcttttactggcaccacctcaggcactaggcacatatattatctctaaagtctacatcaacccattttacacataagaacgttgaggttcaagggttcaataacttgacctgaggccagcctgctgctctgaaagtttcacagaaggctttttccttctgtagcgacagccctgcgactctccttagacctgcaggattctgtggtcctacaggaccccccatctctggtggtttgggagaatttcgtcacgtctcagcttagtgtaaggaactcccttccatcagcagaacagaatgagccagacgctccccctggactttcttttttttttttttttttttgtctttttgctacgtctttgggtcgctcccgaggcatatggaggttcccaggctaggggtccaattggagctgtagccactggcctacgccagagccatagcaacgcaggatccgagccacgtctgcgacctacaccacagctcacggcaatgccagatccttaacccactgagcaaagccagggattgaacccgcaacctcatggttcctagttggattcgttatccgctgagccacgatgggaactcctccccctggactttcacctgcaatgcaggaaagtgacccaggcctggtcacttagcagcttcccacccaaaagaagtagcactcaggttctgataccagtgaaatgttaacagcggctccagtgccagcaagagctagaattaactcctgttgggagaccctaactgtgttaggtctgttgcctgacctctcctggttctgagcagcttggttttcaagctcccccaggaataccatgagcaacaaccaaaaaatccttccaaggcacatacctcttctgcctcggtgagctagaatctccatcggttgcttgtaaccacaatttctgacccgtacctcatctcaagcgcttctcaatatatcagccgcaaacattcgctgagcctttcatgccagagaaggagctcctaagcactcaattagtttgcacagaggaatagtaatcgtgcctttctgtgcacagctctggcataacctatgaaaacggagtttgccacacaaaatagcaatctgcaaacaaccacagctcaactgagagcaaatccaggcccagtccctgctccccgggagccatattccccctaaagaaaaccccttccttgattttgtcaacggtcttgtctttccccacagatgccaggcaagttcctcttggggacagctggccggccacttgaggacttgcgatttccctgacgtaggagaaaggacagctgggtttctgcacacagatgctgccaagcccaacgtcacccttctgggcagctgacccattgccccgggcttgctccctcccctgtgcccctccagacaccagggccatctggattctggaacagccatggggaagatcaggatgactggttctcaggacccctttcctttgcctgaaacgctcttcctttttcaccctctacatcctgcgggcctcagtttaaagatcacttcctcagggaagccctccctgaccacttccccagacaagttcagggccccaggaccctgccctgtttatctcctccatgtctctgtctgtgcagttcattgtttactgactatctccccagctgaattctagcctctgcacaggaagggattgcacctctgttcaccgaatctcaggttatctagcacagcatgtagttccataaatcctgaacgctttaaagatgagtgaaggacattctggcggctcagtgagcgctgaatgagtatctgatttaaagcatgcatctcagcaacaggtgcatcttttaggaccaccgttttctggtgcccaaactcacaagggcagggtgaaaatttagccatccctacttctccccgggtcgtttttagtttgaaggtttgtttcctgtgggttgggactggcccgatttttgtttaacagcagctattgctcagagaggagtttgctagatgccagccttataccacctggttgatggggaaactgaggcccctaccactggctgcaccagcaccggcggggcgagaccagctctctttcagcccagagctcatttcagggtccttcgccccacatggggccaagtccagggcatgcgaagcaaggctcgggaagataagggcacccagacggggatggagtttgaaacttttattaagaacgaatcaagagggaattcccttcatggctcagtggttaacgaacccgactaggatccataaggacaagggtttgatccctggcctcgctcagtgggttaaggatccagcattgccgtgtaggtcacagaggcggctcccatctgtgttgctgtggtgttgctgtggctgagatgtagtctgacagctacagctccgattcgacccctacccggggaacttccacatgccatgggtgcagccctaaaaagcagaagaaaaaaagaagaagaaatcaagagacctggcctctctctctgcccagcctcttccagctgctaccttccactctctccggctagtttcaggttgagcaaggccaggcaggagccctctcgggggctgagcatggatctgggccccagcagcgcccccaaccttcagattcaccttcactctccttgctcagggcccaccagggtctccaagccaaactatgtttgaagtcaagaccaggctttcatgctttggttctgccacttcactcttgagagatggtggccaaacaattaaaacgctgagcctcaatttccctgcctgtaaagtgaggaggcggggggataattcctgctttgctgacttcatagggcttttgtgaggctcaggcgaggtagatatatgtactcactcgtctaactgtccactagcttagagaactctaacaacaactctaggagttctggcagtgggttgagaatccgactgcagctgctcaggtcactacagtggcacgagttcgatccctggccctgtgcagtgggctaaagatctagatagagttgcggcagtgatggcataggttgcagctgtggcttggattcaatccctggcccgagaacttccatatgacgtggtgcagccgtaagggaaaaaaaaaaaaaaaaaaaagatactgtttttctggtcccattagggtcttgcgatcaacgtgtagccagcccatgtcctccagggcccaatcctccacccaacctctcagccaggctctcctcttgaccacatccttctagaaatcctttctgcctctgccttcctggatgtgctccctctgggctctcctccatctcaggtcactcattctcccagttaggacctggcccacctggcagctccgtgctttttcctgccattcacgtcagccaaccacacagggcctgggacaggaactgcagggaacacataccaacactcagatccctggataaggcttgcgtgcgcattccctggggcacaaaacatgcgcacaaagcattgtgtccccaccccactgccctcaccacccctcctttgctggggcatagggcagaacccacagcagacggaaattcccaggctaggggtctaattggagctacaactgccggcctacatcacagccacagcaacgccagatccaagccacatccacgaagtacagcacagctcacagcaacgccggatccttaacccactgcgcgaggccagggattgaaccagcaacctcatggatacttgtcagattcatttccactgtaccccgacaggaactccaccactcctcctttaagagactctatttggcaataaagccagagccaaggctctggcaagagttgcagccaggtctgatcataggcagccaaggtctgtggccctccaagccgggctgggacaagccaagcagatcagctcctcggctggagatttcaatgacatatttttaggtcagcctctctttagaattgcaaggacttttataaataattctgggttaagtatattccacatgatgacccttctgccttcagtccacagtccaaatctacatcactctctggtgtcccagactgacccacctggcttccctctctcaagactaaggctgaagcttttatcagcagaccttgcagcccagggcagggggttgggcaggggggaaacgactttgccccagttgcccttgggaggccacttacccacaagtgtgggttaagtaaagggcactgcggtcacatgcccagtgtgccatctggcttcagcagccaccgtcaaagagggaagaaaaagtgacatgcaacagaatgtaaccggggcatggcctgcaggatgcccagggacctggggggcagaggggtgccaaattcatggggggcttctcagagagggtggtgattaagatgggccttgaaggatgtgtaggagtctgtgggagggtttggggaggaggtgggagggtgtcctgggcatggggaaaagtccagagccatcgaaccaggagagggtttcaggaattgcagcagttccctcaggctggagcagaagttccaaaggatggagtggtgagggtggtgagggcttcagagggctgtctgtatgggaccttggaggtcacccaaaggaatgtgtgctttatcctgagagcagagggagccttggaaaagatggaaaactccaatcaattaggtgtttggaaatgagacttaggctgcagggagagggtgtataggaacaaagaacagggagcatgcagcagcaggggctgggctgaagagggctgcccaccagcacagcaggggcaggggggctggaaggaaagggtctctttttttttagggccacacctgcggcatatggaggttcccaggctaggggtcgacttggagctgtagccactagtctacaccacagccatagcaatgccagatccttaaccccctgagcaaggccagggatcgaactcatgtcctcatggatgttaattgggtttgttaactgctgagccatgacaggaactcctaaagggacactttggagagctggtaaaggggtgggattgactgaactagattagactggaggggaatgtttgttatgcagcataactgcagccaaagctaacagaggggccacatgagcaaatatatagagacagaaaggccactgccatgcttgaagaagcggaacgatggtgctgatggtaccaaagagcaggctgtgtgatgggcattagtttggagagagaaagataggtggggacctgcacgagggagtttctaacaaatatatgaagttgattggattgttgttcccaagtatctattctgggccaataggcagagcttatcgcagtcccattgactttagactcagtcacatgaccagctttgaccaatggaatatggatagaagtgaccatgtgccaattcagagatttaattttttttttttttttttttgtcttttgtcttttgttgttgttgttgttgctatttcttgggctgctcccgcggcatatggaggttcccaggctaggggttgaatcggagctgtagccaccggcctacgccagacccacagcaacgcgggatccgagccgcgtctgcaacctacatacaccacagctcacggcaacgctggatcgttaacccactgagcaagggcagggaccgaacccgcaacctca

SEQ ID NO: 193 - DNA, 22 bp, Artificial Sequence
  Description of Artificial Sequence: Synthetic primer
cttcgtgaaaccgctgtttatt

SEQ ID NO: 194 - DNA, 22 bp, Artificial Sequence
  Description of Artificial Sequence: Synthetic primer
gactggaggactttgtcttctt

SEQ ID NO: 195 - DNA, 22 bp, Artificial Sequence
  Description of Artificial Sequence: Synthetic primer
tgagttccttacgtggaatgtg

SEQ ID NO: 196 - DNA, 21 bp, Artificial Sequence
  Description of Artificial Sequence: Synthetic primer
tcttcaggagatctgggttct

SEQ ID NO: 197 - DNA, 20 bp, Artificial Sequence
  Description of Artificial Sequence: Synthetic primer
ctgctctgcaaacactcaga

SEQ ID NO: 198 - DNA, 18 bp, Artificial Sequence
  Description of Artificial Sequence: Synthetic primer
tcagcagcagtacctcca

SEQ ID NO: 199 - DNA, 26 bp, Artificial Sequence
  Description of Artificial Sequence: Synthetic oligonucleotide
acaccggggagagaagcagaggatgg

SEQ ID NO: 200 - DNA, 26 bp, Artificial Sequence
  Description of Artificial Sequence: Synthetic oligonucleotide
aaaaccatcctctgcttctctccccg

SEQ ID NO: 201 - DNA, 110 bp, Artificial Sequence
  Description of Artificial Sequence: Synthetic polynucleotide
gaaaggacgaaacaccgggtcttcgagaagacctgttttagagctagaaatagcaagttaaaataaggctagtccgttatcaacttgaaaaagtggcaccgagtcggtgc

SEQ ID NO: 202 - DNA, 22 bp, Artificial Sequence
  Description of Artificial Sequence: Synthetic primer
gccttttgctggccttttgctc

SEQ ID NO: 203 - DNA, 505 bp, Artificial Sequence
  Description of Artificial Sequence: Synthetic polynucleotide
ttcctggccttttgctggccttttgctcacatgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaaacaccggggagagaagcagaggatggtttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccg

SEQ ID NO: 204 - DNA, 28 bp, Artificial Sequence
  Description of Artificial Sequence: Synthetic primer
cgggccatttaccgtaagttatgtaacg

SEQ ID NO: 205 - DNA, 127 bp, Artificial Sequence
  Description of Artificial Sequence: Synthetic polynucleotide
gctttatatatcttgtggaaaggacgaaaacaccggggagagaagcagaggatggtttttagagctagaaatagcaagttaaaataaggctagtccgttatcaacttgaaaaagtggcaccgagtcg

SEQ ID NO: 206 - DNA, 127 bp, Artificial Sequence; identical to SEQ ID NO: 205
  Description of Artificial Sequence: Synthetic polynucleotide

SEQ ID NO: 207 - DNA, 126 bp, Artificial Sequence
  Description of Artificial Sequence: Synthetic polynucleotide
gctttatatatcttgtggaaaggacgaaacaccggggagagaagcagaggatggtttttagagctagaaatagcaagttaaaataaggctagtccgttatcaacttgaaaaagtggcaccgagtcg

SEQ ID NO: 208 - DNA, 26 bp, Artificial Sequence
  Description of Artificial Sequence: Synthetic oligonucleotide
acaccgtagaaaaggatgaagaaaag

SEQ ID NO: 209 - DNA, 26 bp, Artificial Sequence
  Description of Artificial Sequence: Synthetic oligonucleotide
aaaacttttcttcatccttttctacg

SEQ ID NO: 210 - DNA, 110 bp, Artificial Sequence; identical to SEQ ID NO: 201
  Description of Artificial Sequence: Synthetic polynucleotide

SEQ ID NO: 211 - DNA, 22 bp, Artificial Sequence
  Description of Artificial Sequence: Synthetic primer
gccttttgctggccttttgctc

SEQ ID NO: 212 - DNA, 600 bp, Artificial Sequence
  Description of Artificial Sequence: Synthetic polynucleotide
tgagcgtcgatttttgtgatgctcgtcaggggggcggagcctatggaaaaacgccagcaacgcggcctttttacggttcctggccttttgctggccttttgctcacatgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccacaccgtagaaaaggatgaagaaaagttttgttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccgcctggctgacc

SEQ ID NO: 213 - DNA, 28 bp, Artificial Sequence
  Description of Artificial Sequence: Synthetic primer
cgggccatttaccgtaagttatgtaacg

SEQ ID NO: 214 - DNA, 122 bp, Artificial Sequence
  Description of Artificial Sequence: Synthetic polynucleotide
gatttcttggctttatatatcttgtggaaaggacgaaaacaccgtagaaaaggatgaagaaaagtttttagagctagaaatagcaagttaaaataaggctagtccgttatcaacttgaaaaa

SEQ ID NO: 215 - DNA, 122 bp, Artificial Sequence; identical to SEQ ID NO: 214
  Description of Artificial Sequence: Synthetic polynucleotide

SEQ ID NO: 216 - DNA, 121 bp, Artificial Sequence
  Description of Artificial Sequence: Synthetic polynucleotide
gatttcttggctttatatatcttgtggaaaggacgaaacaccgtagaaaaggatgaagaaaagtttttagagctagaaatagcaagttaaaataaggctagtccgttatcaacttgaaaaa

SEQ ID NO: 217 - DNA, 26 bp, Artificial Sequence
  Description of Artificial Sequence: Synthetic oligonucleotide
acaccggcctcagaccccacacagag

SEQ ID NO: 218 - DNA, 26 bp, Artificial Sequence
  Description of Artificial Sequence: Synthetic oligonucleotide
aaaactctgtgtggggtctgaggccg

SEQ ID NO: 219 - DNA, 110 bp, Artificial Sequence; identical to SEQ ID NO: 201
  Description of Artificial Sequence: Synthetic polynucleotide

SEQ ID NO: 220 - DNA, 22 bp, Artificial Sequence
  Description of Artificial Sequence: Synthetic primer
gccttttgctggccttttgctc

SEQ ID NO: 221 - DNA, 554 bp, Artificial Sequence
  Description of Artificial Sequence: Synthetic polynucleotide
caacgcggcctttttacggttcctggccttttgctggccttttgctcacatgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaaacaccggcctcagaccccacacagagtttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccgcctggctgaccgcccaacgacccccgccca

SEQ ID NO: 222 - DNA, 28 bp, Artificial Sequence
  Description of Artificial Sequence: Synthetic primer
cgggccatttaccgtaagttatgtaacg

SEQ ID NO: 223 - DNA, 121 bp, Artificial Sequence
  Description of Artificial Sequence: Synthetic polynucleotide
gtatttcgatttcttggctttatatatcttgtggaaaggacgaaaacaccggcctcagaccccacacagagtttttagagctagaaatagcaagttaaaataaggctagtccgttatcaac

SEQ ID NO: 224 - DNA, 121 bp, Artificial Sequence; identical to SEQ ID NO: 223
  Description of Artificial Sequence: Synthetic polynucleotide

SEQ ID NO: 225 - DNA, 119 bp, Artificial Sequence
  Description of Artificial Sequence: Synthetic polynucleotide
gtatttcgatttcttggctttatatatcttgtggaaaggacgaaacaccggcctcagaccccacacagagttttagagctagaaatagcaagttaaaataaggctagtccgttatcaac

SEQ ID NO: 226 - DNA, 26 bp, Artificial Sequence
  Description of Artificial Sequence: Synthetic oligonucleotide
acaccgcaaggggatattcgggtttg

SEQ ID NO: 227 - DNA, 26 bp, Artificial Sequence
  Description of Artificial Sequence: Synthetic oligonucleotide
aaaacaaacccgaatatccccttgcg

SEQ ID NO: 228 - DNA, 110 bp, Artificial Sequence; identical to SEQ ID NO: 201
  Description of Artificial Sequence: Synthetic polynucleotide

SEQ ID NO: 229 - DNA, 22 bp, Artificial Sequence
  Description of Artificial Sequence: Synthetic primer
gccttttgctggccttttgctc

SEQ ID NO: 230 - DNA, 536 bp, Artificial Sequence
  Description of Artificial Sequence: Synthetic polynucleotide
tttacggttcctggccttttgctggccttttgctcacatgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaaacaccgcaaggggatattcgggtttgtttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccgcctggctgaccgcccaacgacccc

SEQ ID NO: 231 - DNA, 28 bp, Artificial Sequence
  Description of Artificial Sequence: Synthetic primer
cgggccatttaccgtaagttatgtaacg

SEQ ID NO: 232 - DNA, 99 bp, Artificial Sequence
  Description of Artificial Sequence: Synthetic oligonucleotide
ggctttatatatcttgtggaaaggacgaaaacaccgcaaggggatattcgggtttgtttttagagctagaaatagcaagttaaaataaggctagtccgt

SEQ ID NO: 233 - DNA, 99 bp, Artificial Sequence; identical to SEQ ID NO: 232
  Description of Artificial Sequence: Synthetic oligonucleotide

SEQ ID NO: 234 - DNA, 98 bp, Artificial Sequence
  Description of Artificial Sequence: Synthetic oligonucleotide
ggctttatatatcttgtggaaaggacgaaacaccgcaaggggatattcgggtttgtttttagagctagaaatagcaagttaaaataaggctagtccgt

SEQ ID NO: 235 - DNA, 26 bp, Artificial Sequence
  Description of Artificial Sequence: Synthetic oligonucleotide
acaccgtgcttttggtcctgagcgtg

SEQ ID NO: 236 - DNA, 26 bp, Artificial Sequence
  Description of Artificial Sequence: Synthetic oligonucleotide
aaaacacgctcaggaccaaaagcacg

SEQ ID NO: 237 - DNA, 110 bp, Artificial Sequence; identical to SEQ ID NO: 201
  Description of Artificial Sequence: Synthetic polynucleotide

SEQ ID NO: 238 - DNA, 22 bp, Artificial Sequence
  Description of Artificial Sequence: Synthetic primer
gccttttgctggccttttgctc

SEQ ID NO: 239 - DNA, 600 bp, Artificial Sequence
  Description of Artificial Sequence: Synthetic polynucleotide
cgtcaggggggcggagcctatggaaaaacgccagcaacgcggcctttttacggttcctggccttttgctggccttttgctcacatgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaaacaccgtgcttttggtcctgagcgtgtttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccgcctggctgaccgcccaacgacccccgcccattgacgtcaata

SEQ ID NO: 240 - DNA, 28 bp, Artificial Sequence
  Description of Artificial Sequence: Synthetic primer
cgggccatttaccgtaagttatgtaacg

SEQ ID NO: 241 - DNA, 99 bp, Artificial Sequence
  Description of Artificial Sequence: Synthetic oligonucleotide
ggctttatatatcttgtggaaaggacgaaaacaccgtgcttttggtcctgagcgtgtttttagagctagaaatagcaagttaaaataaggctagtccgt

SEQ ID NO: 242 - DNA, 99 bp, Artificial Sequence; identical to SEQ ID NO: 241
  Description of Artificial Sequence: Synthetic oligonucleotide

SEQ ID NO: 243 - DNA, 97 bp, Artificial Sequence
  Description of Artificial Sequence: Synthetic oligonucleotide
ggctttatatatcttgtggaaaggacgaaacaccgtgcttttggtcctgagcgtgttttagagctagaaatagcaagttaaaataaggctagtccgt

SEQ ID NO: 244 - DNA, 26 bp, Artificial Sequence
  Description of Artificial Sequence: Synthetic oligonucleotide
acaccgccggggccgcctagagaagg

SEQ ID NO: 245 - DNA, 26 bp, Artificial Sequence
  Description of Artificial Sequence: Synthetic oligonucleotide
aaaaccttctctaggcggccccggcg

SEQ ID NO: 246 - DNA, 110 bp, Artificial Sequence; identical to SEQ ID NO: 201
  Description of Artificial Sequence: Synthetic polynucleotide

SEQ ID NO: 247 - DNA, 22 bp, Artificial Sequence
  Description of Artificial Sequence: Synthetic primer
gccttttgctggccttttgctc

SEQ ID NO: 248 - DNA, 600 bp, Artificial Sequence
  Description of Artificial Sequence: Synthetic polynucleotide
cgtcaggggggcggagcctatggaaaaacgccagcaacgcggcctttttacggttcctggccttttgctggccttttgctcacatgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaaacaccgccggggccgcctagagaaggtttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtacccgttacataacttacggtaaatggcccgcctggctgaccgcccaacgacccccgcccattgacgtcaata

SEQ ID NO: 249 - DNA, 28 bp, Artificial Sequence
  Description of Artificial Sequence: Synthetic primer
cgggccatttaccgtaagttatgtaacg

SEQ ID NO: 250 - DNA, 100 bp, Artificial Sequence
  Description of Artificial Sequence: Synthetic polynucleotide
cgatttcttggctttatatatcttgtggaaaggacgaaaacaccgccggggccgcctagagaaggtttttagagctagaaatagcaagttaaaataaggc

SEQ ID NO: 251 - DNA, 100 bp, Artificial Sequence; identical to SEQ ID NO: 250
  Description of Artificial Sequence: Synthetic polynucleotide

SEQ ID NO: 252 - DNA, 99 bp, Artificial Sequence
  Description of Artificial Sequence: Synthetic oligonucleotide
cgatttcttggctttatatatcttgtggaaaggacgaaacaccgccggggccgcctagagaaggtttttagagctagaaatagcaagttaaaataaggc

SEQ ID NO: 253 - DNA, 22 bp, Artificial Sequence
  Description of Artificial Sequence: Synthetic primer
cttcgtgaaaccgctgtttatt

SEQ ID NO: 254 - DNA, 330 bp, Artificial Sequence
  Description of Artificial Sequence: Synthetic polynucleotide
cgctcctcttcgtgaaaccgctgtttattcttttgacaggagttggaacgcagcaccttcccttcctcccagccctgcctccttctgcagagcagagctcactagaacttgcttcgccttttactctggggggagagaagcagaggatgaggtacgtgaaacgttgaaatgatttgcctccgctttgctggggtcaccgggggggtgggtatcatgagctggctgcagcgtggagagaggagcccccctctccccctgacttcttgctgctccccccagttgttctgaaagaagacaaagtcctccagtccccggcatcggatctaggag

SEQ ID NO: 255 - DNA, 22 bp, Artificial Sequence
  Description of Artificial Sequence: Synthetic primer
gactggaggactttgtcttctt

SEQ ID NO: 256 - DNA, 22 bp, Artificial Sequence
  Description of Artificial Sequence: Synthetic primer
tgagttccttacgtggaatgtg

SEQ ID NO: 257 - DNA, 400 bp, Artificial Sequence
  Description of Artificial Sequence: Synthetic polynucleotide
tggtggtggtgtgcctgtgtctctgacacatctgcgatctcatgagttccttacgtggaatgtgaatagcgagatgaacagtattggtcttcagccctcatctctgcagatgttgcttgacccaaatgagcgttgccttttattttgattttgctttgatttgtctactccatgtacttgagccatgcatttctgtcttagcgatgctttttaaaagtcatttttttggttgattatccagatttgtccacctttgcttctagttgtagaaaaggatgaagaaaatggagttttgcttctagaactaaatcctcctaacccgtgggattcagaacccagatctcctgaagatttggcttttggggaagtgcaggtaaggaaatgttaaattataatattc

SEQ ID NO: 258 - DNA, 21 bp, Artificial Sequence
  Description of Artificial Sequence: Synthetic primer
tcttcaggagatctgggttct

SEQ ID NO: 259 - DNA, 20 bp, Artificial Sequence
  Description of Artificial Sequence: Synthetic primer
ctgctctgcaaacactcaga

SEQ ID NO: 260 - DNA, 282 bp, Artificial Sequence
  Description of Artificial Sequence: Synthetic polynucleotide
accaagaacctgtggggatggctcgtgaggctgctctgcaaacactcagaatggctgagtgccaaggtgaagttcttcctccccaacatggacctgggtgccaggaacgaggcctcagaccccacacagagggtcgtcctacaactcagaaaactgcgtacccagagtcagatcacctggcaggcgttcatccactgtgtgtgcatggagctggacgtgccgctggacctggaggtactgctgctgagcacctggggccacggagaagggctccccagtcag

SEQ ID NO: 261 - DNA, 18 bp, Artificial Sequence
  Description of Artificial Sequence: Synthetic primer
tcagcagcagtacctcca

SEQ ID NO: 262 - DNA, 102 bp, Sus scrofa
gcagagctcactagaacttgtttcgccttttactctggggggagagaagcagaggatgaggagaaaataatgaatgtcaaaggaagagtggttctgtcaatg

SEQ ID NO: 263 - protein, 11 aa, Sus scrofa
MNVKGRVVLSM

SEQ ID NO: 264 - DNA, 102 bp, Sus scrofa; identical to SEQ ID NO: 262

SEQ ID NO: 265 - DNA, 61 bp, Sus scrofa
gcagagctcactagaacttgtttcgccttttactctggggggagagaagcagaggatgagg

SEQ ID NO: 266 - DNA, 61 bp, Sus scrofa; identical to SEQ ID NO: 265

SEQ ID NO: 267 - DNA, 61 bp, Sus scrofa; identical to SEQ ID NO: 265

SEQ ID NO: 268 - DNA, 61 bp, Sus scrofa; identical to SEQ ID NO: 265

SEQ ID NO: 269 - DNA, 61 bp, Sus scrofa; identical to SEQ ID NO: 265

SEQ ID NO: 270 - DNA, 61 bp, Sus scrofa; identical to SEQ ID NO: 265

SEQ ID NO: 271 - DNA, 61 bp, Sus scrofa; identical to SEQ ID NO: 265

SEQ ID NO: 272 - DNA, 59 bp, Sus scrofa
agagctcactagaacttgtttcgccttttactctggggggagagaagcagaggatgagg

SEQ ID NO: 273 - DNA, 59 bp, Sus scrofa; identical to SEQ ID NO: 272

SEQ ID NO: 274 - DNA, 59 bp, Sus scrofa; identical to SEQ ID NO: 272

SEQ ID NO: 275 - DNA, 105 bp, Sus scrofa
agagctcactagaacttgtttcgccttttactctggggggagagaagcagaggatgaggtacgtgaaacgttgaaatgatttacctccgctttgctggggtcacc

SEQ ID NO: 276 - DNA, 59 bp, Sus scrofa; identical to SEQ ID NO: 272

SEQ ID NO: 277 - DNA, 59 bp, Sus scrofa; identical to SEQ ID NO: 272

SEQ ID NO: 278 - DNA, 59 bp, Sus scrofa; identical to SEQ ID NO: 272

SEQ ID NO: 279 - DNA, 66 bp, Sus scrofa
ctccccaacatggacctgggtgccaggaacgaggcctcagaccccacacagagggtcgtcctacaa

SEQ ID NO: 280 - DNA, 23 bp, Sus scrofa
gaggtactgctgctgagcacctg

SEQ ID NO: 281 - protein, 22 aa, Sus scrofa
LPNMDLGARNEASDPTQRVVLQ

SEQ ID NO: 282 - protein, 8 aa, Sus scrofa
EVLLLSTW

SEQ ID NO: 283 - DNA, 66 bp, Sus scrofa; identical to SEQ ID NO: 279

SEQ ID NO: 284 - DNA, 23 bp, Sus scrofa
gaggtactgctgctgagcacctg

SEQ ID NO: 285 - DNA, 65 bp, Sus scrofa
ctccccacatggacctgggtgccaggaacgaggcctcagaccccacacagagggtcgtcctacaa

SEQ ID NO: 286 - DNA, 16 bp, Sus scrofa
gaggtactgctgctga

SEQ ID NO: 287 - DNA, 64 bp, Sus scrofa
ctcccacatggacctgggtgccaggaacgaggcctcagaccccacacagagggtcgtcctacaa

SEQ ID NO: 288 - DNA, 16 bp, Sus scrofa
gaggtactgctgctga

SEQ ID NO: 289 - DNA, 65 bp, Sus scrofa; identical to SEQ ID NO: 285

SEQ ID NO: 290 - DNA, 16 bp, Sus scrofa
gaggtactgctgctga

SEQ ID NO: 291 - DNA, 66 bp, Sus scrofa; identical to SEQ ID NO: 279

SEQ ID NO: 292 - DNA, 16 bp, Sus scrofa
gaggtactgctgctga

SEQ ID NO: 293 - DNA, 65 bp, Sus scrofa
ctcccaccatggacctgggtgccaggaacgaggcctcagaccccacacagagggtcgtcctacaa

SEQ ID NO: 294 - DNA, 16 bp, Sus scrofa
gaggtactgctgctga

SEQ ID NO: 295 - DNA, 106 bp, Sus scrofa
tggacctgggtgccaggaacgaggcctcagaccccacacagagggtcgtcctacaactcagaaaactgcgtacccagagtcagatcacctggcaggcgttcatcca

SEQ ID NO: 296 - protein, 36 aa, Sus scrofa
MDLGARNEASDPTQRVVLQLRKLRTQSQITWQAFIH

SEQ ID NO: 297 - DNA, 106 bp, Sus scrofa; identical to SEQ ID NO: 295

SEQ ID NO: 298 - DNA, 106 bp, Sus scrofa; identical to SEQ ID NO: 295

SEQ ID NO: 299 - DNA, 106 bp, Sus scrofa; identical to SEQ ID NO: 295

SEQ ID NO: 300 - DNA, 106 bp, Sus scrofa; identical to SEQ ID NO: 295

SEQ ID NO: 301 - DNA, 106 bp, Sus scrofa; identical to SEQ ID NO: 295

SEQ ID NO: 302 - DNA, 106 bp, Sus scrofa; identical to SEQ ID NO: 295

SEQ ID NO: 303 - DNA, 86 bp, Sus scrofa
agatcacctggcaggcgttcatccactgtgtgtgcatggagctggacgtgccgctggacctggaggtactgctgctgagcacctgg

SEQ ID NO: 304 - protein, 29 aa, Sus scrofa
QITWQAFIHCVCMELDVPLDLEVLLLSTW

SEQ ID NO: 305 - DNA, 86 bp, Sus scrofa; identical to SEQ ID NO: 303

SEQ ID NO: 306 - DNA, 78 bp, Sus scrofa
agatcacctggcaggcgttcatccactgtgtgtgcatggagctggacgtgccgctggacctggaggtactgctgctga

SEQ ID NO: 307 - DNA, 78 bp, Sus scrofa; identical to SEQ ID NO: 306

SEQ ID NO: 308 - DNA, 78 bp, Sus scrofa; identical to SEQ ID NO: 306

SEQ ID NO: 309 - DNA, 78 bp, Sus scrofa; identical to SEQ ID NO: 306

SEQ ID NO: 310 - DNA, 78 bp, Sus scrofa; identical to SEQ ID NO: 306

What is claimed is:

1. A genetically modified pig which comprises a disruption in a gene encoding NOD-like receptor family CARD domain containing 5 (NLRC5), wherein said genetically modified pig expresses major histocompatibility complex (MHC) I molecules, wherein said genetically modified pig has reduced expression of said MHC I molecules as compared to a non-genetically modified counterpart pig, and wherein cells from said genetically modified pig when cocultured with human peripheral blood mononuclear cells (PBMCs) induce a lower production of cytokine Interleukin 6 (Il-6) and a lower CD8+ T cell immune response as compared to cells from said non-genetically modified counterpart pig, as measured by an in vitro mixed lymphocyte reaction assay.

2. The genetically modified pig of claim 1, wherein said genetically modified pig further comprises a disruption in a gene encoding glycoprotein galactosyltransferase 1,3 (GGTA1).

3. The genetically modified pig of claim 1, wherein said genetically modified pig further comprises reduced protein expression of an endogenous gene not expressed in a human.

4. A population of genetically modified pigs, wherein said population of genetically modified pigs comprises two or more genetically modified pigs of claim 1.

5. A pancreas or pancreatic islet isolated from said genetically modified pig of claim 1.

6. A genetically modified pig cell, wherein said genetically modified pig cell comprises a disruption in a gene encoding NOD-like receptor family CARD domain containing 5 (NLRC5), wherein said genetically modified pig cell expresses MHC I molecules, wherein said genetically modified pig cell has reduced expression of said MHC I molecules as compared to a non-genetically modified counterpart pig cell, and wherein said genetically modified pig cell when cocultured with human peripheral blood mononuclear cells (PBMCs) induce a lower production of cytokine Interleukin 6 (Il-6) and a lower CD8+ T cell immune response as compared to cells from said non-genetically modified counterpart pig cell, as measured by an in vitro mixed lymphocyte reaction assay.

7. A method for treating a condition in a subject in need thereof comprising:
    a) administering a tolerizing vaccine to said subject; and
    b) transplanting a genetically modified cell, tissue, or organ to said subject to treat said condition,
    wherein said genetically modified cell, tissue, or organ is from a pig and comprises a disruption in a gene encoding NLRC5, wherein said genetically modified cell, tissue, or organ expresses MHC I molecules, wherein said genetically modified cell, tissue, or organ has reduced expression of said MHC I molecules as compared to a non-genetically modified counterpart cell, tissue, or organ, and
    wherein said genetically modified cell, or a cell obtained from said genetically modified tissue, or organ, when cocultured with human peripheral blood mononuclear cells (PBMCs) induce a lower production of cytokine Interleukin 6 (Il-6) and a lower CD8+ T cell immune response as compared to cells from said non-genetically modified counterpart cell, tissue or organ, as measured by an in vitro mixed lymphocyte reaction assay.

8. The method of claim 7, further comprising administering to said subject one or more pharmaceutical agents that inhibit T cell activation, B cell activation, dendritic cell activation, or any combination thereof.

9. The method of claim 8, wherein said one or more pharmaceutical agents comprise an anti-CD 40 agent or an anti-CD 40L agent.

10. A method for making a genetically modified pig comprising:
    a) disrupting a gene encoding NLRC5 in a porcine fetal fibroblast cell using CRISPR/Cas;
    b) transferring a nucleus of said porcine fetal fibroblast cell to a porcine enucleated oocyte to generate an embryo; and
    c) transferring said embryo into a surrogate pig and growing said embryo to said genetically modified pig in said surrogate pig, wherein said genetically modified pig expresses MHC I molecules, wherein said genetically modified pig has reduced expression of said MHC I molecules as compared to a non-genetically modified counterpart pig, and wherein cells from said genetically modified pig when cocultured with human peripheral blood mononuclear cells (PBMCs) induce a lower production of cytokine Interleukin 6 (Il-6) and a lower CD8+ T cell immune response as compared to cells from said non-genetically modified counterpart pig, as measured by an in vitro mixed lymphocyte reaction assay.

11. The genetically modified pig cell of claim 6, wherein said genetically modified pig cell further comprises a disruption in a gene encoding GGTA1.

12. The method of claim 7, wherein said genetically modified cell, tissue or organ from said pig further comprises a disruption in a gene encoding GGTA1.

13. The method of claim 10, wherein said porcine fetal fibroblast cell further comprises a disruption in a gene encoding GGTA1.

* * * * *